United States Patent 12,508,308 (INFLUENZA mRNA VACCINES) - sequence listing, part 47

SEQ ID NO: 183199 - RNA, 1701 nt, Artificial Sequence
  derived and/or modified sequence opt5 from hemagglutinin__InfluenzaA__AAY47023
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaauggggccucuucgucgagcgguccaaggccuauucuaauuguuacccuuaugaugugcccgacuacguuagccugcgcucccuuguggcuagcucugggacgcuggaauuuaacaaugaguccuucaacuggaccggagucgcccaaaauggcacaagcucugcuugcaaaagacgguccgauaagagcuuuuucucucgccucaacuggcugcaccagcuuaaguauaaauacccugcccugaaugugaccaugcccaacaaugagaaguuugacaaacucuauauuuggggcguucaucacccugggacagauuccgaccagaucagccuguacgcgcaggccuccggaagagugaccgucucuacgaagcggagccaacagacagugauuccgaacaucggcucccgccccugggugagaggggucagcucucggauuuccaucuacuggaccauuguuaaaccuggagauauccugcucaucaacagcacaggcaaucugauugcuccccgcggguauuucaagaucagaucuggaaagagcuccauuaugcggucugacgccccuaucggcaaauguaacagcgaaugcauuacccccaauggcuccaucccgaacgacaagccuuuucagaaugugaaccgcaucaccuacggggcuugucccagauaugugaaacagaauacacuuaagcuggccacgggaaugcggaacgucccugagaaacaagcgcgcggcauuuucggggccaucgcuggauuuauugaaaauggcugggaggggaugauggauggaugguacggcuucagacaccagaacagcgagggcaccgggcaggccgcugaccucaagucuacacaagccgccaucaaucagauuaacggaaaacugaaucggcuuaucgaaaagaccaacgagaaguuucaucagaucgaaaaagaguucuccgaaguggagggccgcauucaggaucuggagaaguauguugaagacacaaaaaucgaucucuggagcuacaaugcugagcugcugguggcgcucgaaaaccaacacaccauugaccugacggauucugagaugaacaaacuuuucgaaagaacaaagaagcagcugcgggagaaugccgaggacauggggaacggaugcuuuaagaucuaucauaaaugugauaaugcuugcauuggcuccaucagaaacgggaccuacgaccacgaugucuaccgcgacgaagcccucaauaaccgguuccagauuaagggcguggagcugaaaagcggauauaaggacuggauccuuuggaucuccuuugccauuucuugcuuccugcucuguaucguucugcugggcuuuauuaugugggcuugccagaaagggaauaucagauguaacauuugcaucuga

SEQ ID NO: 183200 - RNA, 1701 nt, Artificial Sequence; identical to SEQ ID NO: 183196
  derived and/or modified sequence opt5 from hemagglutinin__InfluenzaA__AAY47052

SEQ ID NO: 183201 - RNA, 1701 nt, Artificial Sequence
  derived and/or modified sequence opt5 from hemagglutinin__InfluenzaA__AAY47075
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacccuggaauuuaacaaugagucuuucaacuggacgggagucgcccaaaauggcaccuccagcgcuugcaaaagacggucuaacaaguccuuuuucagccgccucaauuggcugcaccagcuuaagaacaaauauccugcccugaaugugacaaugcccaacaacgagaaguuugacaaacucuacauuuggggcguucaucacccugggaccgauucugaccagaucucccuguaugcgcaggccagcggaagagugacagucuccaccaagcggucucaacagacggugauuccgaauaucggcagccgccccagagugcgggauauuuccagccgcaucucuauuuacuggacaaucgucaaaccuggggacauccugcucauuaacuccaccggaaaucugaucgcucccagaggcuacuucaagauucggagcgggaagucuagcaucaugcgcuccgacgccccuauuggaaaauguaacucugaaugcaucacacccaauggcagcaucccgaacgauaagccuuuucagaauguuaacagaauuaccuauggcgcuuguccccgguacgugaaacagaauacccuuaagcuggccacagggaugcgcaacgugccugagaaacaaacgagaggaaucuucggcgcgauugccggguuuaucgaaaauggaugggagggcaugauggacgggugguauggauuccggcaccagaacuccgagggcaccggccaggcugccgaucucaagagcacacaagcugccauuaaucagaucaacgggaaacugaauagacuuaucgaaaagaccaacgagaaguuucaucagauugaaaaagaguucucugaagucgagggacgcauccaggaccuggagaaguacguggaagauacaaaaauugaccucugguccuauaacgccgagcugcugguugcucucgaaaaucaacacaccaucgaucugacggacagcgagaugaacaaacuuuucgaacggacaaagaagcagcugagagagaaugcggaggauaugggcaacgggugcuuuaagauuuaccauaaaugugacaaugccugcaucggaucuauucgcaacggcaccuaugaucacgacguguaccgggacgaagcucucaauaacagauuccagaucaagggggucgagcugaaauccggcuacaaggauuggauccuuuggauuagcuuugccaucuccugcuuccugcucuguauugugcugcugggauuuaucaugugggccugccagaaaggcaauauucgcuguaacaucugcaucuga

SEQ ID NO: 183202 - RNA, 1701 nt, Artificial Sequence
  derived and/or modified sequence opt5 from hemagglutinin__InfluenzaA__AAY47085
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuucccucuacgcgcaggccagcggccgcaucacaguuuccaccaaaagaucucaacagacagugauuccgaacgucgggagccggccccgcgugagagauguguccagccggaucucuauuuacuggaccaucgucaagccuggagacauccugcugauuaauuccaccggcaaccucaucgcuccccgcggguauuucaagauuagaagcggaaaaucuagcaucaugcgguccgacgccccuauuggcaaguguaauucugagugcaucacacccaacggcagcaucccgaaugauaaaccuuuucagaacguuaaucgcauuacguacggggcuugucccagauaugugaagcagaacacccugaaacuugccacaggaaugcggaaugugccugaaaagcaaacccgcggcaucuucggggcgauugccggauuuaucgagaacggcugggaagggauggucgacggaugguacggcuucagacaccaaaauuccgagggcacagggcaggcugccgaucugaaaagcacccaggcugccauuaaccagaucaauggaaagcucaaccggcugaucggcaagacgaaugagaaauuucaccagauugaaaaggaguucucugaaguggaggggagaauccaggaccuugaaaaauauguugaggauacaaagauugaccugugguccuacaacgccgagcuccugguggcucuggaaaaccaacauaccaucgaucucaccgacagcgagaugaauaaacuguucgaacgcacaaagaagcagcuucgggagaacgcggaagauaugggaaauggcugcuuuaaaauuuaucacaagugugacaacgccugcaucgagucuauuagaaaugggaccuacgaucaugacgucuaccgcgacgaggcucugaacaaucgguuccagaucaaaggcguggaacucaaguccggauauaaagauuggauccuguggauuagcuuugccaucuccugcuuccuucuguguguugcccuccugggcuuuauuaugugggcuugccagaaggggaacaucagauguaauauuugcaucuga

SEQ ID NO: 183203 - RNA, 1701 nt, Artificial Sequence
  derived and/or modified sequence opt5 from hemagglutinin__InfluenzaA__AAY58320
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacauuuccagccggaucucuaucuacuggaccauugugaagccuggagacauccugcugauuaacuccaccggcaaucucaucgcuccccgcggguauuucaagauuagaagcggaaaaucuagcaucaugcgguccgaugccccuaucggcaaguguaacucugagugcauuacacccaauggcagcaucccgaacgacaaaccuuuucagaaugugaaccgcauuacguacggggcuugucccagauaugucaagcagaauacccugaaacuugccacaggaaugcggaacguuccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaaguggaggggagaauccaggaucuugaaaaauaugucgaggacacaaagauugaucugugguccuacaaugccgagcuccugguggcucuggaaaaccaacauaccaucgaccucaccgauagcgagaugaacaaacuguucgaacgcacaaagaagcagcuucgggagaaugcggaagacaugggaaacggcugcuuuaaaauuuaucacaagugugauaaugccugcaucgggucuaucagaaacggcaccuacgaccaugacguuuaccgcgaugaggcucugaauaaccgguuccagauuaaaggaguggagcucaaguccggcuauaaagacuggauccuguggauuagcuuugccaucuccugcuuccuucugugugucgcccuccugggguuuauuaugugggcuugccagaagggaaauaucagauguaacaucugcauuuga

SEQ ID NO: 183204 - RNA, 1701 nt, Artificial Sequence
  derived and/or modified sequence opt5 from hemagglutinin__InfluenzaA__AAY59035
augaagaccaucauugcccugagcuacauccucugccugguguucgcucagaaacuuacagucaacgacaauuccacggccacccugugucucggccaccaugcgguucccaacgggacacuggugaagaccauuacaaaugaucacaucgaggugaccaacgcuacagaacuuguccaaucuagcuccaccggaagaauuugcgacucuccucaucagauccuggauggcgagaauuguacgcucaucgacgcccugcugggggauccgcacugcgacggauuucagaacaaagaaugggaucucuucguggagcggagcaccgccuauuccaauuguuaccccuaugacguuccugauuacgcuucucugcgcagccuuguggccuccagcggcacacuggaauuuaacaaugagucuuucaacuggaccggggucgcucagaauggaacauccagcgccugcaagagacggucuauuaaauccuuuuucagccgccucaacuggcugcaucaacuuaaguauaaguaccccgcgcugaaugugaccaugccuaacaaugagaaauuugacaagcucuauaucuggggcguucaccaccccucuacggauuccgaccagauuagccuguacgcccaggcuuccggcagagugacagucucuaccaaacggagccagcaaacagugaucccuaacauugggucccgcccgugggugagaggagucagcucucggaucuccauuuacuggaccaucguuaagcccggcgauauccugcucauuaacagcaccgggaaucugaucgccccucgcggauauuucaaaauuagaucuggcaagagcuccaucaugcggucuaacgcucccauugggaaguguaauagcgaaugcaucacaccuaacggauccauccccaaugacaaaccguuucagaacgugaaucgcauuacguacggcgccuguccuagauaugugaagcagaacacccuuaaacuggcgacaggcaugcggaauguccccgagaagcagacccgcgggaucuucggagccauugcuggcuuuaucgaaaacgggugggagggaaugguggacggcugguacggguucagacaucaaaauagcgagggaacaggccaggccgcugaucucaaaucuacccaggccgccauuaaccaaaucaauggcaagcugaaccggcuuaucgagaaaacgaaugaaaaguuucaccagauugaaaaggaguucuccgaaguugaggggagaauccaggaccuggagaaauauguggaagauacaaagauugaccucuggagcuacaacgcugagcugcuggucgcgcucgaaaaccagcauaccaucgaucugaccgacucugagaugaauaaacuuuucgaacgcacacggaagcaacugagagagaacgccgaggauaugggaaauggcugcuuuaaaauuuaucacaagugugacaacgcuugcaucggguccauucgcaauggaaccuacgaucacgacguguaccgggaugaagcccucaacaauagauuccagaucaagggcguugagcugaaaagcggguauaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183205 - RNA, 1701 nt, Artificial Sequence
  derived and/or modified sequence opt5 from hemagglutinin__InfluenzaA__AAY64202
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcgagcgcagaucuaacaaguccuuuuucagccggcugaauuggcucacacaucugaaguauaaauacccugcccuuaacgucaccaugcccaauaacgagaaguuugacaaacuguauaucuggggagugcaccauccugggacggauucugaccagauuucccucuacgcgcaggccagcggccgcaucacaguuuccaccaagagaucucaacagacagugauuccgaacaucgggagccggccccgcgucagagauguguccagccggauuucuaucuacuggaccaucgugaaaccuggagacauucugcugaucaauuccaccggcaaccucauugcuccccgcggguauuucaagaucagaagcggaaagucuagcauuaugcgguccgacgccccuaucggcaaauguaauucugaaugcaucacacccaacggcagcauuccgaaugauaagccuuuucagaacgucaaucgcaucacguacggggcuugucccagauauguuaaacagaacacccugaagcuggccacaggaaugcggaaugugccugagaaacaaaaccgcggcauuuucggggcgaucgccggauuuauugaaaauggcugggaggggaugguggacggaugguacggcuucagacaccagaacuccgagggcaccgggcaggcugccgaucuuaagagcacacaagcugccaucaaucagaucaacggaaaacucaaucggcugauuggcaagaccaacgaaaaguuucaccagaucgagaaagaguucucugaagucgaagggcgcauucaggaccuugagaaguauguggaggauacgaaaaucgaccugugguccuacaacgccgaacuccugguugcucuggagaaucaacauacaauugaucucaccgacagcgaaaugaacaagcuguucgagagaaccaaaaagcagcuucgggaaaaugcggaggauaugggaaacggcugcuuuaagaucuaucacaaaugugacaaugccugcauugggucuaucagaaacggcacauacgaucaugacguguaccgcgacgaggcucugaauaaccgguuccagaucaagggagucgaacucaaauccggcuauaaggauuggauucuguggaucagcuuugccauuuccugcuuccuucuguguguggcccuccugggguuuaucaugugggcuugccagaaaggaaauauuagaugugacaucugcaucuga

SEQ ID NO: 183206 - RNA, 1701 nt, Artificial Sequence
  derived and/or modified sequence opt5 from hemagglutinin__InfluenzaA__AAY64212
augaagaccaucauugcccugagcuacauccucugccugguguucgcucagaaaauucccgucaacgacaauuccacagccacgcuuugucugggccaccaugcgguuccuaacgggacccucgugaagacaaucaccaaugagcacauugaagugacaaacgcuaccgagcugguccaaucuagcuccacaggaagaaucugcgauucuccgcaucagauccuugacggcgaaaauuguacccugauugaugcccuccugggggacccccacugcgauggauuucagaacaaagagugggaccuguucguggaacggagcacggccuauuccaauuguuacccuuaugauguucccgacuacgcuucucuccgcagccugguggccuccagcggcacccuugaguuuaacaaugagucuuucaacuggacaggggucgcucagaauggaaccuccagcgccugcaagagacggucuaucaaauccuuuuucagccgccugaacuggcuccaucaacugaaguauaaguacccugcgcuuaaugugacaaugcccaacaaugaaaaauuugauaagcuguauauuuggggcguucaccacccuucuaccgacuccgaucagaucagccucuacgcccaggcuuccggcagagugacggucucuacaaaacggagccagcaaaccgugauuccgaacaucgggucccgccccugggugagaggagucagcucucggauuuccaucuacuggacaaucguuaagccuggcgacauucugcugaucaacagcaccgggaaucucauugcccccagaggauauuucaaaaucagaucuggcaagagcuccauuaugcggucuaacgcucugaucgggaaguguaauagcgagugcaucaccccuaacggauccauucccaaugauaaaccguuucagaacgugaaucgcaucacauacggcgccuguccuagauaugugaagcagaacacgcuuaaacuggcgaccggcaugcggaauguccccgaaaagcagacacgcgggauuuucggagccaucgcuggcuuuauugagaacgggugggagggaaugguggacggcugguacggguucagacaucaaaauagcgaaggaaccggccaggccgcugaccucaaaucuacacaggccgccaucaaccaaaucaauggcaagcugaaccggcuuauugagaaaaccaaugaaaaguuucaccagaucgagaaggaguucuccgaaguugaggggcgcauucaggaucuggaaaaauauguggaggacacgaagaucgaucucuggagcuacaacgcugaacugcuggucgcgcucgagaaccagcauacaauugaccugaccgauucugaaaugaauaaacuuuucgagcgcacccggaagcaacugagagagaacgccgaagacaugggaaauggcugcuuuaaaaucuaucacaagugugauaacgcuugcauuggguccauccgcaauggaacauacgaccacgauguguaccgggacgaggcccucaacaauagauuccagaucaagggcguugaacugaaaagcggguauaaggauuggauucuuuggaucuccuuugccauuucuugcuuccugcucugugugguccugcugggcuuuaucaugugggcuugccagaaaggaaacauucgcuguaauaucugcaucuga

SEQ ID NO: 183207 - RNA, 1701 nt, Artificial Sequence
  derived and/or modified sequence opt5 from hemagglutinin__InfluenzaA__AAY64222
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccauuggcagaaucugcgacucuccgcaccagauccuggauggggagaauuguacacucauugacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacccuggaauuuaacaaugagucuuucaacuggacgggagucgcccaaaauggcaccuccagcucuugcaaaagacgguccgacaagagcuuuuucucucgccucaacuggcugcaccagcuuaaguauaaauacccugcucugaaugugacaaugcccaacaaugagaaguuugauaaacucuauaucuggggcguucaucacccugggaccgacuccgaucagauuagccuguacgcccaggcguccggaagagugacagucucuaccaagcggagccaacagacggugaucccgaacauuggcucccgccccugggugagaggggucagcucucggaucuccauuuacuggacaaucguuaaaccuggagacauccugcucauuaacagcaccggcaaucugaucgcuccccgcggguauuucaagauuagaucuggaaagagcuccaucaugcggucugacgccccuauuggcaaauguaacagcgaaugcaucacacccaauggcuccaucccgaacgauaagccuuuucagaaugugaaccgcauuaccuacgggcccuguccuagauaugugaaacagaauacccuuaagcuggccacaggaaugcggaacguccccgagaaacaaacgcgcggcaucuucggggcuauugccggauuuaucgaaaauggcugggaggggaugauggacggaugguacggcuucagacaccagaacagcgagggcaccgggcaggcggccgaucucaagucuacacaagcugccauuaaucagaucaacggaaaacugaaucggcuuaucgaaaagaccaacgagaaguuucaucagauugaaaaagaguucuccgaaguggagggcagaauccaggaccuggagaaguauguugaagauacaaaaauugaccucuggagcuacaaugcugagcugcugguggcccucgaaaaccaacacaccaucgaucugacggacucugagaugaacaaacuuuucgaaaagacaaagaagcagcugcgcgagaaugccgaggauauggggaacggaugcuuuaaaauuuaucauaagugugacaaugcuugcaucggcuccauucggaacgggaccuacgaucacgacgucuacagagacgaagcgcucaauaaccgcuuccagaucaaaggcguggagcuuaagagcggauauaaagauuggauccuguggauuuccuuugccaucucuugcuuccugcucuguauuguucugcugggcuuuaucaugugggcuugccagaaggggaauauucgguguaacaucugcaucuga

SEQ ID NO: 183208 - RNA, 1701 nt, Artificial Sequence
  derived and/or modified sequence opt5 from hemagglutinin__InfluenzaA__AAY64262
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcaugggauccauuagaaauggcaccuacgaccacgaugucuaccgcgacgaagcccucaacaaucgguuccagaucaaggggguggagcugaaaagcggcuauaaggacuggauucuuuggaucuccuuugccaucucuugcuuccugcucuguguugugcugcugggauuuauuaugugggcuugccagaaaggcaacaucagauguaauauuugcaucuga

SEQ ID NO: 183209 - RNA, 1701 nt, Artificial Sequence
  derived and/or modified sequence opt5 from hemagglutinin__InfluenzaA__AAY64272
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuucccucuacgcgcaggccagcggccgcaucacaguuuccaccaaaagaucucaacagacagugauuccgaacaucgggagccggccccgcgucagagauguguccagccggauuucuaucuacuggaccaucgugaagccuggagacauucugcugaucaauuccaccggcaaccucauugcuccccgcggguauuucaagaucagaagcggaaaaucuagcauuaugcgguccgacgccccuaucggcaaguguaauucugagugcaucacacccaacggcagcauuccgaaugauaaaccuuuucagaacgucaaucgcaucacguacggggcuugucccagauauguuaagcagaacacccugaaacuugccacaggaaugcggaaugugccugaaaagcaaacccgcggcauuuucggggcgaucgccggauuuauugagaacggcugggaagggaugguggacggaugguacggcuucagacaccaaaauuccgagggcacagggcaggcugccgaucugaaaagcacccaggcugccaucaaccagaucaauggaaagcucaaccggcugauuggcaagacgaaugagaaauuucaccagaucgaaaaggaguucucugaagucgaggggcgcauucaggaccuugaaaaauauguggaggauacaaagaucgaccugugguccuacaacgccgagcuccugguugcucuggaaaaccaacauaccauugaucucaccgacagcgagaugaauaaacuguucgaaagaacaaagaagcagcuucgggagaacgcggaagauaugggaaauggcugcuuuaaaaucuaucacaagugugacaacgccugcauugagucuaucagaaaugggaccuacgaucaugacguguaccgcgacgaggcucugaacaaucgguuccagaucaaaggcgucgaacucaaguccggauauaaagauuggauucuguggaucagcuuugccauuuccugcuuccuucuguguguggcccuccugggcuuuaucaugugggcuugccagaaggggaacauuagauguaauaucugcaucuga

SEQ ID NO: 183210 - RNA, 1701 nt, Artificial Sequence
  derived and/or modified sequence opt5 from hemagglutinin__InfluenzaA__AAY64282
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcauuggauccaucagaaauggcaccuacgaccacgaugucuaccgcgacgaagcccucaacaaucgguuccagauuaaggggguggagcugaaaagcggcuauaaggacuggauccuuuggaucuccuuugccauuucuugcuuccugcucuguguugugcugcugggauuuaucaugugggcuugccagaaaggcaacauuagauguaauaucugcauuuga

SEQ ID NO: 183211 - RNA, 1701 nt, Artificial Sequence
  derived and/or modified sequence opt5 from hemagglutinin__InfluenzaA__AAY64292
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacagacaaaauuugcgauucuccgcaccagauccuggacggcgggaauuguacccucaucgaugcccugcugggagacccccauugcgauggcuuucagaacaaggagugggaccucuucgucgaaagaagcaaagccuauuccaauuguuacccuuaugaugugcccgacuacguuucucugcggagccuuguggcuuccagcgggacgcuggaguuuaacaaugaaucuuucaacuggaccggagucgcccaaaauggcacauccagcgcuugcaagcgcagaucugauaaguccuuuuucagccggcucaacuggcugcaccagcuuaaaaauaaguauccugcccugaacgugaccaugcccaauaacgagaaauuugacaagcucuacauuuggggcguucaucacccugggacagauucugaccagaucucccuguaugcgcaggccagcggacgcgugaccgucuccacgaaaagaucucaacagacagugauuccgaacaucggcagccggccccgcgugagagacauuuccagccggaucucuauuuacuggaccaucgucaagccuggggauauccugcucauuaauuccacaggaaaccugaucgcuccccgcggcuacuucaagauuagaagcgggaaaucuagcaucaugcgguccgacgccccuauuggaaaguguaauucugagugcaucacccccaacggcagcaucccgaaugauaaaccuuuucagaacguuaaucgcauuaccuauggcgcuugucccagauacgugaagcagaacacacuuaaacuggccacggggaugcggaaugugccugaaaagcaaacccgcggaaucuucggcgcgauugccggguuuaucgagaacggaugggaaggcauggucgacgggugguauggauucagacaccaaaauuccgagggcacaggccaggcugccgaucucaaaagcacccaggcugccauuaaccagaucaaugggaagcugaaccggcuuaucgagaagacaaaugaaaaauuucaucagauugagaaggaguucucugaaguggaaggaagaauccaggaccuggagaaauacguugaggauaccaagauugaccucugguccuauaacgccgaacugcugguggcucucgagaaccaacacacgaucgaucugacagacagcgaaaugaauaaacuuuucgagcgcaccaagaagcagcugcgggaaaacgcggaggauaugggcaaugggugcuuuaaaauuuaccauaagugugacaacgccugcaucggaucuauuagaaauggcaccuaugaccacgaugucuaccgcgacgaggcucucaacaaucgguuccagaucaaagggguggaacugaaguccggcuacaaagauuggauccuuuggauuagcuuugccaucuccugcuuccugcucuguauuguucugcugggauuuaucaugugggccugccagaagggcaacauuagauguaauaucugcaucuga

SEQ ID NO: 183212 - RNA, 1701 nt, Artificial Sequence
  derived and/or modified sequence opt5 from hemagglutinin__InfluenzaA__AAY64302
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucacaaugcccaauaacgacaaguucgauaaacucuauaucuggggcgugcaucacccuucuacagacuccgaucagaccagccuguacgcccaggcuuccgggcggguuacggugucuacaaagcgcagccagcaaaccgucauuccgaauaucggauccagacccugggugcggggcgugagcucucgcauuuccaucuacuggacaauugucaaaccuggggacauccugcucaucaacagcaccggaaaccugauugcccccagaggcuauuuuaagauccggucuggaaagagcuccauuaugaaaucugacgcuccuaucgggaaguguaauagcgagugcauuacccccaacggcuccaucccgaaugauaaaccuuuccagaacguuaaucgcaucacauacggcgccugucccagauaugugaagcagaacacgcuuaaacuggcgaccgggaugcggaaugugccugaaaagcagacacgcggaauuuuuggcgccaucgcuggguucauugagaacggaugggaaggcauggucgacgggugguacggauuuagacaccaaaauagcgagggcaccggccaggccgcugaucucaaaucuacacaggccgccaucaaccaaauuaaugggaagcugaaccggcuuaucgagaagaccaaugaaaaauuccaucagaucgagaaggaguucacggaaguggaaggacgcauucaggaccuggagaaauauguugaggauacaaagaucgaccucugguccuacaacgcugaacugcugguggcgcucgagaaucagcacaccauugaucugaccgacagcgaaaugaacaaacuuuuugagagaacacggaagcaacugagagaaaacgccgaggauaugggcaaugggugcuucaagaucuaucauaaaugugacaacgucugcauuggaucuauccgcaauggcaccuacgaucacgacguguaccgggacgaggcucucaacaauagauuucagauuaaggggguugaacugaaauccggcuauaaggauuggauccuuuggaucagcuucgccacauccugcuuucugcucugugugguccugcugggauucauuaugugggccugccagaaaggcaacauccgcuguaauauuugcaucuga

SEQ ID NO: 183213 - RNA, 1701 nt, Artificial Sequence; identical to SEQ ID NO: 183207
  derived and/or modified sequence opt5 from hemagglutinin__InfluenzaA__AAY64312

SEQ ID NO: 183214 - RNA, 1701 nt, Artificial Sequence; identical to SEQ ID NO: 183210
  derived and/or modified sequence opt5 from hemagglutinin__InfluenzaA__AAY64322

SEQ ID NO: 183215 - RNA, 1701 nt, Artificial Sequence
  derived and/or modified sequence opt5 from hemagglutinin__InfluenzaA__AAY64332
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgggaucugcgacucuccgcaccagauccuugauggagagaauuguacgcugauugacgcucuccugggcgauccccagugcgacggguuucaaaacaaaaagugggaucuguucgucgaaagaagcaaagccuauuccaauuguuacccuuaugacgugcccgauuacgccucucuccggagccugguugcuuccagcggaacccuugaguuuaacaaugaaucuuucgacuggacaggcgugacccagaacggcacauccagcgccugcaagcgcagaucuaauaaguccuuuuucagccggcugaacuggcucacccaucugaaauuuaaguauccugcucuuaaugucacgaugcccaacaaugagaaauucgauaagcuguacaucuggggagugcaccauccugggacagacucugaucagauuucccucuaugcccaggcgagcggccgcaucaccguuuccacaaaaagaucucaacagaccgugauuccgaacaucgggagccggccccgcgucagagacguguccagccggauuucuaucuacuggaccaucgugaagccuggagacauucugcugaucaacuccacaggcaaucucauugcccccagaggguacuuuaagaucagaagcggaaaaucuagcauuaugcgguccgaugcuccuaucggcaaguguaacucugagugcaucacgcccaauggcagcauuccgaacgacaaaccuuuccagaaugucaaccgcaucaccuauggggccugucccagauacguuaagcagaauacacugaaacuugcuaccggaaugcggaacgugccugaaaagcaaacacgcggcauuuuuggggccaucgcgggauucauugagaauggcugggaagggaugguggauggaugguauggcuuuagacaccagaacuccgagggcaccgggcaggccgcugaccugaaaagcacgcaagccgcuaucaaucagaucaacggaaagcucaaucggcugauuggcaagacaaacgagaaauuccaccagaucgaaaaggaguucucugaagucgaggggcgcauucaggaucuugaaaaauacguggaggacaccaagaucgaucugugguccuauaaugccgagcuccugguugcccuggaaaaccaacauaccauugaccucacagauagcgagaugaacaaacuguuugaacgcaccaagaagcagcuucgggagaaugcugaagacaugggaaacggcugcuucaaaaucuaccacaagugugauaaugcgugcauugggucuaucagaaacggcacauaugaccaugacguguaccgcgaugaggcccugaauaaccgguuucagaucaaaggagucgagcucaaguccggcuacaaagacuggauucuguggaucagcuucgcuauuuccugcuuucuucuguguguggcccuccugggguucaucaugugggccugccagaagggaaauauuagaugugauaucugcaucuga

SEQ ID NO: 183216 - RNA, 1701 nt, Artificial Sequence
  derived and/or modified sequence opt5 from hemagglutinin__InfluenzaA__AAY64342
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcauuggauccaucagaaauggcaccuacgaccacgaugucuaccgcgacgaagcccucaacaaucgguuccagauuaaggggguggagcugaaaagcggcuauaaggacuggauccuuuggaucuccuuugccacaucuugcuuccugcucuguguugugcugcugggauuuauuaugugggcuugccagaaaggcaacaucagauguaauauuugcaucuga

SEQ ID NO: 183217 - RNA, 1701 nt, Artificial Sequence; identical to SEQ ID NO: 183056
  derived and/or modified sequence opt5 from hemagglutinin__InfluenzaA__AAY64352

SEQ ID NO: 183218 - RNA, 1701 nt, Artificial Sequence
  derived and/or modified sequence opt5 from hemagglutinin__InfluenzaA__AAY64362
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucgacuggaccggagugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggcgugcaccauccugggacggacucugaucagauuucccucuacgcgcaggccagcggacgcaucacaguuuccaccaaaagaucucaacagacagugauuccgaacaucggcagccggccccgcgucagagacauuuccagccggaucucuaucuacuggaccauugugaagccuggggacauccugcugauuaacuccaccggaaaucucaucgcuccccgcggcuauuucaagauuagaagcgggaaaucuagcaucaugcgguccgaugccccuaucggaaaguguaacucugaaugcauuacacccaauggcagcaucccgaacgacaaaccuuuucagaaugugaaccgcauuacguacggcgcuugucccagauauaucaagcagaauacccugaaacuugccacagggaugcggaacgucccugagaagcaaacccgcggaauuuucggcgcgaucgccggguuuaucgaaaauggaugggagggcaugguugaugggugguacggauucagacaccagaacuccgagggcacaggccaggcugccgaccugaaaagcacccaagcugccauuaaucagaucaacgggaagcucaaucggcugauuggaaagacgaacgaaaaauuucaccagaucgagaaggaguucucugaaguggaaggccgcauucaggaucuugagaaauauguggaggacacaaagaucgaucugugguccuacaaugccgaacuccuggucgcucuggagaaccaacauaccauugaccucaccgauagcgaaaugaacaaacuguucgagagaacaaagaagcagcuucgggaaaaugcggaggacauggggaacggaugcuuuaaaaucuaucacaagugugauaaugccugcaucggcucuauuagaaacgggaccuacgaccaugacguguaccgcgaugaggcucugaauaaccgguuccagaucaaaggcguugaacucaaguccggauauaaagacuggauucuguggaucagcuuugccauuuccugcuuccuucuguguguggcccuccugggcuuuaucaugugggcuugccagaaggggaauaucagauguaacauuugcaucuga

SEQ ID NO: 183219 - RNA, 1701 nt, Artificial Sequence; identical to SEQ ID NO: 183210
  derived and/or modified sequence opt5 from hemagglutinin__InfluenzaA__AAY64382

SEQ ID NO: 183220 - RNA, 1701 nt, Artificial Sequence
  derived and/or modified sequence opt5 from hemagglutinin__InfluenzaA__AAY64392
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauaacgaccagauuucucucuacgcgcaggccuccggccgcaucacaguuagcaccaaaagaucccaacagacagugauuccgaauaucgggucucggccccgcgucagagaugugagcucccggauuagcaucuacuggaccaucgugaagccuggagacauucugcugaucaacucuaccggcaaucucauugcuccccgcggguauuucaagaucagauccggaaaaagcucuauuaugcggagcgacgccccuaucggcaaguguaacuccgagugcaucacacccaauggcucuauuccgaacgauaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggacggaugguacggcuucagacaccagaacagcgagggcacagggcaggcugccgaucugaaauccacccaagcugccaucaaucagaucaacggaaagcucaaucggcugauuggcaagacgaacgagaaauuucaccagaucgaaaaggaguucagcgaagucgaggggcgcauucaggaccuugaaaaauauguggaggauacaaagaucgaccuguggucuuacaacgccgagcuccugguugcucuggaaaaucaacauaccauugaucucaccgacuccgagaugaacaaacuguucgaaagaacaaagaagcagcuucgggagaaugcggaagauaugggaaacggcugcuuuaaaaucuaucacaagugugacaaugccugcauugggagcaucagaaacggcaccuacgaucaugacguguaccgcgacgaggcucugaauaaccgguuccagaucaaaggagucgagcucaagucuggcuauaaagauuggauucuguggaucuccuuugccauuagcugcuuccuucuguguguggcccuccugggguuuaucaugugggcuugccagaagggaaauauuagauguaacaucugcaucuga

SEQ ID NO: 183221 - RNA, 1701 nt, Artificial Sequence; identical to SEQ ID NO: 183212
  derived and/or modified sequence opt5 from hemagglutinin__InfluenzaA__AAY64402

SEQ ID NO: 183222 - RNA, 1701 nt, Artificial Sequence; identical to SEQ ID NO: 183210
  derived and/or modified sequence opt5 from hemagglutinin__InfluenzaA__AAY98037

SEQ ID NO: 183223 - RNA, 1701 nt, Artificial Sequence; identical to SEQ ID NO: 183210
  derived and/or modified sequence opt5 from hemagglutinin__InfluenzaA__AAY98047

SEQ ID NO: 183224 - RNA, 1701 nt, Artificial Sequence; identical to SEQ ID NO: 183071
  derived and/or modified sequence opt5 from hemagglutinin__InfluenzaA__AAY98057

SEQ ID NO: 183225 - RNA, 1701 nt, Artificial Sequence
  derived and/or modified sequence opt5 from hemagglutinin__InfluenzaA__AAY98067
augaagaccaucauugcccugagcuacauccucugccugguguucgcucaggagcuucccggcaacgacaauuccacagccacgcugugucucgggcaccaugcggucccuaacggaacccugguuaaaacaauuaccaaugaucaaaucgaagugacaaacgcuaccgagcuugugcagucuagcuccacaggcagaauuugcgacucuccgcaccagauccuggauggggaaaauuguacccucaucgacgcccugcugggagauccccauugcgacggcuuucagaacaaggagugggaucucuucgucgaacggagcaaagccuauuccaauuguuacccuuaugacgugcccgauuacguuucucugcgcagccuuguggcuuccagcgggacgcuggaguuuaacaaugagucuuucaacuggaccggagucgcccaaaauggcacauccagcgcuugcaagagacggucugacaaauccuuuuucagccgccucaacuggcugcaccagcuuaaguauaaguacccugcccugaaugugaccaugcccaacaaugaaaaauuugauaagcucuauauuuggggcguucaucacccugggacagacucugaucagaucucccuguacgcgcaggccagcggaagagugaccgucuccacgaaacggucucaacagacagugauuccgaacaucggcagcgggcccugggugcgcggagucuccagcagaauuucuaucuacuggaccauuguuaagccuggcgacauccugcucaucaacuccacagggaaucugauugcuccccggggauauuucaaaauccgcagcggcaagucuagcauuaugagauccgacgccccuaucggcaaguguaacucugagugcauuacccccaaugggagcaucccgaacgauaaaccuuuucagaaugugaaccggaucaccuacggacccuguccucgcuaugugaagcagaauacacuuaaacuggcuacgggcaugagaaacguccccgaaaagcaaacccgggggauuuucggagccaucgcgggcuuuauugagaaugggugggagggaaugauggacggcugguacggcuuccgccaccagaacuccgaagggacaggacaggccgcugaucucaaaagcacccaagccgcuaucaaucagauuaacggcaagcugaauagacuuaucgagaaaacaaacgaaaaguuucaucagaucgagaaggaguucucugaaguggaggggcggauucaggaccuggaaaaauauguugaggauaccaagaucgaccucugguccuacaaugccgaacugcugguggcccucgagaaccaacacacgauugaucugacagacagcgaaaugaacaaacuuuucgagagaaccaagaaacagcugcgcgagaaugcugaagauaugggaaacggcugcuuuaagaucuaucauaagugugacaaugcgugcauugggucuauccggaacggcaccuacgaucacgacgucuacagagacgaggcccucaauaaccgcuuccagauuaaaggaguggaacugaaguccggcuauaaagauuggauccuuuggaucagcuuugcuauuuccugcuuccugcucuguaucguucugcugggguuuauuaugugggccugccagaagggaaauauccgguguaacauuugcaucuga

SEQ ID NO: 183226 - RNA, 1701 nt, Artificial Sequence
  derived and/or modified sequence opt5 from hemagglutinin__InfluenzaA__AAY98077
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccgccucuagaauuugcgacagcccgcaccagauccuggauggcgagaauuguacacucaucgacgcccugcugggggauccccauugcgacggauuucagaacaaagaaugggaucucuucgucgagcgguccaaggcuuauucuaauuguuacccuuaugacgugcccgauuacguuagccugcgcucccuuguggccagcucuggcacccuggaauuuaacaaugaguccuucaacuggacgggggucgcucaaaauggaaccagcucugccugcaaaagacgguccgacaagagcuuuuucucucgccucaacuggcugcaccagcuuaaguauaaauacccugcgcugaaugugacaaugcccaacaaugagaaguuugauaaacucuauauuuggggcguucaucacccuggcaccgacuccgaucagaucagccuguacgcccaggcuuccgggagagugacagucucuaccaagcggagccaacagacggugauuccgaacaucggaucccgccccugggugagaggcgucagcucucggauuuccaucuacuggacaauuguuaaaccuggggacauccugcucaucaacagcaccggaaaucugauugcccccagaggcuauuucaagaucagaucuggaaagagcuccauuaugcggucugacgcuccuaucgggaaauguaacagcgaaugcauuacacccaauggcuccaucccgaacgauaagccuuuucagaaugugaaccgcaucaccuacggcgccugucccagauaugugaaacagaauacccuuaagcuggcgacagggaugcggaacgucccugagaaacaaacgcgcggaauuuucggcgccaucgcuggguuuauugaaaauggaugggagggcaugauggacgggugguacggauucagacaccagaacagcgagggcaccggccaggccgcugaucucaagucuacacaagccgccaucaaucagauuaacgggaaacugaaucggcuuaucgaaaagaccaacgagaaguuucaucagaucgaaaaagaguucuccgaaguggagggacgcauucaggaccuggagaaguauguugaagauacaaaaaucgaccucuggagcuacaaugcugagcugcugguggcgcucgaaaaccaacacaccauugaucugacggacucugagaugaacaaacuuuucgaacgcacaaagaagcagcugcgggagaaugccgaggauaugggcaacgggugcuuuaagaucuaucauaaaugugacaaugcuugcauuggauccaucagaaacggcaccuacgaucacgacgucuaccgcgacgaagcccucaauaaccgguuccagauuaaggggguggagcugaaaagcggcuauaaggauuggauccuuuggaucuccuuugccauuucuugcuuccugcucuguaucguucugcugggauuuauuaugugggcuugccagaaaggcaauaucagauguaacauuugcaucuga

SEQ ID NO: 183227 - RNA, 1701 nt, Artificial Sequence
  derived and/or modified sequence opt5 from hemagglutinin__InfluenzaA__AAY98087
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuuccgggcggguuacggugucuacaaagcgcagccagcaaaccgucauuccgaacaucggauccagacccugggugcggggcgugagcucucgcauuuccaucuacuggacaauugucaaaccuggggacauccugcucaucaacagcaccggaaaucugauugcccccagaggcuauuucaagauccggucuggaaagagcuccauuaugcgcucugacgcuccuaucgggaaauguaacagcgagugcauuacccccaauggcuccaucccgaacgauaagccuuuucagaauguuaacagaaucacauacggcgccuguccccgguaugugaaacagaauacgcuuaagcuggcgaccgggaugcgcaacgugccugaaaaacagacaagaggaauuuucggcgccaucgcuggguuuauugagaauggaugggaaggcauggucgacgggugguacggauuccggcaccaaaacagcgagggcaccggccaggccgcugaucucaagucuacacaggccgccaucaaucaaauuaacgggaaacugaauagacuuaucgagaagaccaacgaaaaguuucaucagaucgagaaagaguucuccgaaguggaaggacgcauucaggaccuggagaaguauguugaggauacgaaaaucgaccucuggagcuacaaugcugaacugcugguggcgcucgagaaccagcacacaauugaucugaccgacucugaaaugaacaagcuguucgagcggaccagaaaacaacugcgcgaaaaugccgaggauaugggcaacgggugcuuuaagaucuaucauaagugugacaaugcuugcauuggauccauccggaacggcacauacgaucacgacgucuacagagacgaggcccucaauaaccgcuuccagauuaaagggguggaacuuaagagcggcuauaaagauuggauccuuuggaucuccuuugccauuucuugcuuccugcucuguguugugcugcugggauuuaucaugugggcuugccagaagggcaauauucgguguaacaucugcauuuga

SEQ ID NO: 183228 - RNA, 1701 nt, Artificial Sequence; identical to SEQ ID NO: 183210
  derived and/or modified sequence opt5 from hemagglutinin__InfluenzaA__AAY98097

SEQ ID NO: 183229 - RNA, 1701 nt, Artificial Sequence; identical to SEQ ID NO: 183210
  derived and/or modified sequence opt5 from hemagglutinin__InfluenzaA__AAY98107

SEQ ID NO: 183230 - RNA, 1701 nt, Artificial Sequence
  derived and/or modified sequence opt5 from hemagglutinin__InfluenzaA__AAY98117
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagaggcucuaacaaguccuuuuucagccggcucaauuggcugcaccagcuuaaguauaaauacccugcgcugaacgucaccaugcccaauaacgagaaguuugaaaaacucuauauuuggggagugcaucacccuucuacagacuccgaucagaucagccuguacgcccaggcuuccgggcgcguuaccgugucuacgaagagaagccaacagacagucauuccgaacaucggcucccggcccugggugcgcggggugagcucuagaauuuccaucuacuggaccauugucaaaccuggagacauccugcucaucaauagcacaggcaaccugauugcuccccggggguauuucaagauccgcucuggaaagagcuccauuaugagaucugaugccccuaucggcaaauguaauagcgagugcauuacccccaacggcuccaucccgaaugacaagccuuuucagaacguuaaucggaucaccuacggggccuguccccgcuaugugaaacagaacacacuuaagcuggcgacgggaaugagaaaugugccugaaaaacaaacccggggcauuuucggggccaucgcuggauuuauugagaacggcugggaggggauggucgacggaugguacggcuuccgccaccagaauagcgaaggcacagggcaggccgcugaucucaagucuacccaagccgccaucaaccagauuaauggaaaacugaacagacuuaucgagaagacaaaugaaaaguuucaucagaucgagaaagaguucuccgaaguggagggccggauucaggaccuggaaaaguauguugaggauaccaaaaucgaccucuggagcuacaacgcugaacugcugguggcgcucgagaaccaacacacgauugaucugacagacucugaaaugaauaaacuuuucgagagaaccaagaagcagcugcgcgagaacgccgaagauauggggaauggaugcuuuaagaucuaucauaaaugugacaacgcuugcauuggcuccauccggaaugggaccuacgaucacgacgucuacagagaugaggcccucaacaaucgcuuccagauuaagggcguggaacugaaaagcggauauaaggacuggauccuuuggaucuccuuugccauuucuugcuuccugcucuguguugugcugcugggcuuuaucaugugggcuugccagaaagggaacauucgguguaauaucugcauuuga

SEQ ID NO: 183231 - RNA, 1701 nt, Artificial Sequence; identical to SEQ ID NO: 183210
  derived and/or modified sequence opt5 from hemagglutinin__InfluenzaA__AAY98147

SEQ ID NO: 183232 - RNA, 1701 nt, Artificial Sequence; identical to SEQ ID NO: 183210
  derived and/or modified sequence opt5 from hemagglutinin__InfluenzaA__AAY98157

SEQ ID NO: 183233 - RNA, 1701 nt, Artificial Sequence
  derived and/or modified sequence opt5 from hemagglutinin__InfluenzaA__AAY98167
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgcaacggagccagcagacagucauuccgaacaucggaucccgccccugggugagaggcgugagcucucggauuuccaucuacuggaccauugucaagccuggggauauccugcucaucaauagcacaggaaaccugauugcccccagaggcuauuucaaaaucagaucugggaaaagcuccauuaugcggucugacgcuccuaucggaaaguguaauagcgaaugcauuacccccaacggcuccaucccgaaugacaaaccuuuucagaacguuaaucgcaucaccuacggcgccugucccagauaugugaagcaaaacacacuuaaacuggcgacggggaugcggaaugugccugagaagcagacccgcggaauuuucggcgccaucgcuggguuuauugaaaacggaugggagggcauggucgaugggugguacggauucagacaccagaauagcgagggcacaggccaagccgcugaccucaaaucuacccaggccgccaucaaccagauuaaugggaagcugaaccggcuuaucgaaaagacaaaugagaaguuucaucagaucgaaaaggaguucuccgaaguggagggacgcauucaagaucuggagaaauauguugaagacaccaagaucgaucucuggagcuacaacgcugagcugcugguggcgcucgaaaaccagcacacgauugaccugacagauucugagaugaauaaacuuuucgaacgcaccaagaaacagcugcgggagaacgccgaggacaugggcaaugggugcuuuaagaucuaucauaagugugauaacgcuugcauuggauccaucagaaauggcaccuacgaccacgaugucuaccgcgacgaagcccucaacaaucgguuccagauuaaagggguggagcuuaagagcggcuauaaagacuggauccuguggaucuccuuugccauuucuugcuuccugcucuguguugugcugcugggauuuaucaugugggcuugccaaaagggcaacauuagauguaauaucugcauuuga

SEQ ID NO: 183234 - RNA, 1701 nt, Artificial Sequence
  derived and/or modified sequence opt5 from hemagglutinin__InfluenzaA__AAY98177
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcuggccugcugguggcgcucgagaaccaacacacgauugaccugacagauucugaaaugaauaaacuuuucgagcgcaccaagaagcagcugcgggaaaacgccgaggacauggggaauggaugcuuuaagaucuaucauaaaugugauaacgcuugcauuggcuccaucagaaaugggaccuacgaccacgaugucuaccgcgacgaggcccucaacaaucgguuccagauuaagggcguggaacugaaaagcggauauaaggacuggauccuuuggaucuccuuugccauuucuugcuuccugcucuguguugugcugcugggcuuuaucaugugggcuugccagaaagggaacauuagauguaauaucugcauuuga

SEQ ID NO: 183235 - RNA, 1701 nt, Artificial Sequence
  derived and/or modified sequence opt5 from hemagglutinin__InfluenzaA__AAY98195
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaagcuguucgaacgcacccggaaacagcugagagagaacgccgaggacaugggcaaugggugcuuuaagaucuaucauaagugugauaacgcuugcauuggauccauccgcaauggcaccuacgaccacgaugucuaccgggacgaagcccucaacaauagauuccagauuaaagggguggagcuuaagagcggcuauaaagacuggauccuuuggaucuccuuugccauuucuugcuuccugcucuguguugugcugcugggauuuaucaugugggcuugccagaagggcaacauucgcuguaauaucugcauuuga

SEQ ID NO: 183236 - RNA, 1701 nt, Artificial Sequence; identical to SEQ ID NO: 183210
  derived and/or modified sequence opt5 from hemagglutinin__InfluenzaA__AAY98207

SEQ ID NO: 183237 - RNA, 1701 nt, Artificial Sequence; identical to SEQ ID NO: 183212
  derived and/or modified sequence opt5 from hemagglutinin__InfluenzaA__AAY98217

SEQ ID NO: 183238 - RNA, 1701 nt, Artificial Sequence; identical to SEQ ID NO: 183210
  derived and/or modified sequence opt5 from hemagglutinin__InfluenzaA__AAY98227

SEQ ID NO: 183239 - RNA, 1701 nt, Artificial Sequence; identical to SEQ ID NO: 183210
  derived and/or modified sequence opt5 from hemagglutinin__InfluenzaA__AAY98237

SEQ ID NO: 183240 - RNA, 1701 nt, Artificial Sequence
  derived and/or modified sequence opt5 from hemagglutinin__InfluenzaA__AAY98247
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcuccccgcggcuauuucaagaucagaucuggaaagagcuccauuaugcggucugacgccccuaucgggaaauguaauagcgaaugcauuacccccaacggcuccaucccgaaugacaagccuuuucagaacguuaaucgcaucaccuacggcgccugucccagauauauuaaacagaacacacuuaagcuggcgacggggaugcggaaugugccugagaaacaaacccgcggaaucuucggcgccauugcuggguuuaucgaaaacggaugggagggcaugguggaugggugguacggauucagacaccagaauagcgagggcacaggccaggccgcugaccucaagucuacccaagccgccauuaaccagaucaaugggaaacugaaccggcuuaucgaaaagacaaaugagaaguuucaucagauugaaaaagaguucuccgaagucgagggaagaauccaggaucuggagaaguauguggaagacaccaaaauugaucucuggagcuacaacgcugagcugcugguugcgcucgaaaaccaacacacgaucgaccugacagauucugagaugaauaaacuuuucgaacgcaccaagaagcagcugcgggagaacgccgaggacaugggcaaugggugcuuuaagauuuaucauaaaugugauaacgcuugcaucggauccauuagaaauggcaccuacgaccacgauguguaccgcgacgaagcccucaacaaucgguuccagaucaagggggucgagcugaaaagcggcuauaaggacuggauccuuuggauuuccuuugccaucucuugcuuccugcucugugugguucugcugggauuuauuaugugggcuugccagaaaggcaacaucagauguaauauuugcaucuga

SEQ ID NO: 183241 - RNA, 1701 nt, Artificial Sequence; identical to SEQ ID NO: 183210
  derived and/or modified sequence opt5 from hemagglutinin__InfluenzaA__AAY98319

SEQ ID NO: 183242 - RNA, 1701 nt, Artificial Sequence
  derived and/or modified sequence opt5 from hemagglutinin__InfluenzaA__AAY98329
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcucuggggagaguuaccguguccacgaagcggucucaacagacagucauuccgaacaucggaagccgccccugggugagaggcguguccagccggauuucuaucuacuggaccauugucaaaccuggggauauccuccugaucaauuccacaggaaaccuuauugcccccagaggcuauuucaagaucagaagcgggaagucuagcauuaugcgguccgacgcuccuaucggaaaauguaauucugaaugcauuacccccaacggcagcaucccgaaugacaagccuuuucagaacguuaaucgcaucaccuacggcgccugucccagauaugugaaacagaacacacugaagcucgcgacggggaugcggaaugugccugagaaacaaacccgcggaauuuucggcgccaucgcuggguuuauugaaaacggaugggagggcauggucgaugggugguacggauucagacaccucaauuccgagggcacaggccaggccgcugaccuuaagagcacccaggccgccaucaaccaaauuaaugggaaacugaaccggcucaucgaaaagacaaaugagaaguuucaucagaucgaaaaagaguucucugaaguggagggacgcauucaggaucuggagaaguauguugaagacaccaaaaucgaucugugguccuacaacgcugagcuccugguggcgcuugaaaaccagcacacgauugaccugacagauagcgagaugaauaagcuguucgaacgcaccaaaaagcaacugcgggagaacgccgaggacaugggcaaugggugcuuuaagaucuaucauaaaugugauaacgcuugcauuggaucuaucagaaauggcaccuacgaccacgaugucuaccgcgacgaagcccuuaacaaucgguuccagauuaaggggguggagcugaaauccggcuauaaggacuggauccucuggaucagcuuugccauuuccugcuuccugcuguguguugugcuccugggauuuaucaugugggcuugccagaaaggcaacauuagauguaauaucugcauuuga

SEQ ID NO: 183243 - RNA, 1701 nt, Artificial Sequence; identical to SEQ ID NO: 183210
  derived and/or modified sequence opt5 from hemagglutinin__InfluenzaA__AAY98339

SEQ ID NO: 183244 - RNA, 1701 nt, Artificial Sequence; identical to SEQ ID NO: 183210
  derived and/or modified sequence opt5 from hemagglutinin__InfluenzaA__AAY98353

SEQ ID NO: 183245 - RNA, 1701 nt, Artificial Sequence
  derived and/or modified sequence opt5 from hemagglutinin__InfluenzaA__AAY98366
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucacaaugcccaauaacgacaaguucgauaaacucuauaucuggggcgugcaucacccugggacagacucugaucagaccucccuguacgcccaggcuagcggacggguuacgguguccacaaagcgcucucagcaaaccgucauuccgaauaucggcagcagacccugggugcgcgggguguccagccggauuucuaucuacuggacaauugucaaaccuggagacauccugcucaucaacuccaccggcaaccugauugcccccagaggguauuuuaagauccggagcggaaagucuagcauuaugcgcuccgacgcuccuaucggcaaauguaauucugagugcauuacccccaacggcagcaucccgaaugauaagccuuuccagaacguuaauagaaucacauacggggccuguccccgguaugugaaacagaacacgcuuaagcuggcgaccggaaugcgcaaugugccugaaaaacagacaagaggcauuuuuggggccaucgcuggauucauugagaacggcugggaagggauggucgacggaugguacggcuuucggcaccaaaauuccgagggcaccgggcaggccgcugaucucaagagcacacaggccgccaucaaccaaauuaauggaaaacugaacagacuuaucgagaagaccaaugaaaaguuccaucagaucgagaaagaguucacggaaguggaaggccgcauucaggaccuggagaaguauguugaggauacaaaaaucgaccucuggucuuacaacgcugaacugcugguggcgcucgagaaucagcacaccauugaucugaccgacuccgaaaugaacaaacuuuuugagcggacaagaaagcaacugcgcgaaaacgccgaggauauggggaauggaugcuucaagaucuaucauaagugugacaacgcuugcauuggcagcauccggaaugggaccuacgaucacgacgucuacagagacgaggcccucaacaaucgcuuucagauuaaaggcguggaacugaagucuggauauaaagauuggauccuuuggaucuccuucgccacaagcugcuuucugcucuguguugugcugcugggcuucauuaugugggcuugccagaaggggaacauccgguguaauauuugcaucuga

SEQ ID NO: 183246 - RNA, 1701 nt, Artificial Sequence
  derived and/or modified sequence opt5 from hemagglutinin__InfluenzaA__AAY98376
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuauuaaguccuuuuucagccgccucaacuggcugcaccagcuuaaguauaaauacccugcgcugaaugucaccaugcccaacaaugacaaguuugauaaacucuauaucuggggcgugcaucacccuucuacagacuccgaucagaccagccuguacgcccaggcuuccgggagaguuacggugucuacaaagcggagccaacagaccgucauuccgaacaucggaucccgccccugggugagaggcgugagcucucggauuuccaucuacuggacaauugucaaaccuggggacauccugcucaucaacagcaccggaaaucugauugcccccagaggcuauuucaagaucagaucuggaaagagcuccauuaugcggucugacgcuccuaucgggaaauguaacagcgagugcauuacccccaauggcuccaucccgaacgauaagccuuuucagaauguuaaccgcaucacauacggcgccugucccagauaugugaaacagaauacgcuuaagcuggcgaccgggaugcggaacgugccugaaaaacaaacacgcggaauuuucggcgccaucgcuggguuuauugagaauggaugggaaggcauggucgacgggugguacggauucagacaccagaacagcgagggcaccggccaggccgcugaucucaagucuacacaagccgccaucaaucagauuaacgggaaacugaaucggcuuaucgagaagaccaacgaaaaguuucaucagaucgagaaagaguucuccgaaguggaaggacgcauucaggaccuggagaaguauguugaggauacgaaaaucgaccucuggagcuacaaugcugaacugcugguggcgcucgagaaccaacacacaauugaucugaccgacucugaaaugaacaagcuguucgagcgcacccggaaacagcugagagaaaaugccgaggauaugggcaacgggugcuuuaagaucuaucauaagugugacaaugcuugcauuggauccauccgcaacggcacauacgaucacgacgucuaccgggacgaggcccucaauaacagauuccagauuaaagggguggaacuuaagagcggcuauaaagauuggauccuuuggaucuccuuugccauuucuugcuuccugcucuguguugugcugcugggauuuaucaugugggcuugccagaagggcaauauucgcuguaacaucugcauuuga

SEQ ID NO: 183247 - RNA, 1701 nt, Artificial Sequence
  derived and/or modified sequence opt5 from hemagglutinin__InfluenzaA__AAY98386
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggggaaauuguacccucaucgacgcccugcugggcgauccccauugcgacggguuucagaacaaagagugggaucucuucgucgaacggagcaagguguauuccaauuguuacccuuaugacguucccgauuacgccucucugcgcagccuuguggcuuccagcggaacgcuggaguuuaacaaugaaucuuucaacuggaccggcgucgcccaaaauggcacauccagcgcuugcaaaagacggucuauuaaguccuuuuucagccgccucaacuggcugcaccagcuuaaguauaaauacccugcccugaaugugaccaugcccaacaaugagaaguuugacaaacucuauaucuggggaguucaucacccuucuacagauuccgaccagauuagccuguacgcgcaggccuccgggagagugaccgucucuacgaagcggagccaacagacagugaucccgaacauuggcucccgccccugggugagaggggucagcucucggaucuccauuuacuggaccaucguuaaaccuggagauauccugcucauuaacagcacaggcaaucugaucgcuccccgcggguauuucaagauuagaucuggaaagagcuccaucaugcggucugacgccccuauuggcaaauguaacagcgagugcaucacccccaauggcuccaucccgaacgacaagccuuuucagaaugugaaccgcauuaccuacggggcuugucccagauaugugaaacagaauacacuuaagcuggccacgggaaugcggaacgucccugaaaaacaaacccgcggcaucuucggggcgauugccggauuuaucgagaauggcugggaagggaugguggauggaugguacggcuucagacaccagaacagcgagggcacagggcaggcugccgaccucaagucuacccaagcugccauuaaucagaucaacggaaaacugaaucggcuuaucgagaagacaaacgaaaaguuucaucagauugagaaagaguucuccgaaguugaaggcagaauccaggaucuggagaaguauguggaggacaccaaaauugaucucuggagcuacaaugccgaacugcuggucgcucucgagaaccaacacacgaucgaccugacagauucugaaaugaacaaacuuuucgagcgcaccaagaagcagcugcgggaaaaugcggaggacauggggaacggaugcuuuaagauuuaucauaaaugugauaaugccugcaucggcuccauuagaaacgggaccuacgaccacgauguguaccgcgacgaggcucucaauaaccgguuccagaucaagggcguugaacugaaaagcggauauaaggacuggauccuuuggauuuccuuugccaucucuugcuuccugcucugugugguccugcugggcuuuauuaugugggccugccagaaagggaauaucagauguaacauuugcaucuga

SEQ ID NO: 183248 - RNA, 1701 nt, Artificial Sequence; identical to SEQ ID NO: 183210
  derived and/or modified sequence opt5 from hemagglutinin__InfluenzaA__AAY98396

SEQ ID NO: 183249 - RNA, 1701 nt, Artificial Sequence; identical to SEQ ID NO: 183210
  derived and/or modified sequence opt5 from hemagglutinin__InfluenzaA__AAY98406

SEQ ID NO: 183250 - RNA, 1701 nt, Artificial Sequence
  derived and/or modified sequence opt5 from hemagglutinin__InfluenzaA__AAZ32946
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcgaggccuauuccaauuguuacccuuaugacgugcccgauuacgcuucucuccggagccugaucgccuccagcggaacgcuugaauuuaccaacgagucuuucaauuggacaggcguuacccagaacggcacauccagcgcuugcaaacgcagaucuaauaaguccuuuuucagccggcugaacuggcucacccaucugaaguauaaauacccugcccuuaaugugacgaugcccaacaaugagaaguuugacaaacuguauauuuggggaguccaccauccugggacagauucugaccagaucucccucuacgcgcaggccagcggccgcauuaccguguccacaaagagaucucaacagaccguuaucccgaacauugggagccggccccgcgugagagaugucuccagccggaucucuaucuacuggaccauugugaaaccuggagacauccugcugauuaacuccacaggcaaucucaucgcuccccgcggguauuucaagauuagaagcggaaagucuagcaucaugcgguccgacgccccuaucggcaaauguaacucugaaugcauuacgcccaauggcagcaucccgaacgauaagccuuuucagaauauuaaccgcaucaccuacgggacaugucccagauaugugaaacagaauacccugaaacuugcuacaggaaugcggaacgucccugagaaacaaacccgcggcauuuucggggccaucgcgggauuuaucgaaaauggcugggaggggaugguugacggaugguacggcuucagacaccagaacuccgagggcacggggcaggccgcugaucucaagagcacacaagccgcuauuaaucagaucaacggaaaacugaaucggcugauuggcaagaccaacgaaaaguuucaccagaucgagaaagaguucucugaaguggaagggcgcauucaggaccuugagaaguauguggaggauaccaaaaucgaccugugguccuacaaugccgaacuccuggucgcccuggagaaccaacauacaauugaucucaccgacagcgaaaugaacaagcuguucgagagaacaaagaagcagcuucgggaaaaugcugaggauaugggaaacggcugcuuuaagaucuaucacaaaugugacaaugcgugcaucgggucuauuagaaacggcacguacgaucaugacguguaccgcgacgaggcccugaauaaccgguuccagaucaagggaguugaacucaaauccggcuauaaggauuggauucuguggaucagcuuugcuauuuccugcuuccuucugugugugguccuccugggguuuaucaugugggccugccagaaaggaaauaucagauguaacauuugcaucuga

SEQ ID NO: 183251 - RNA, 1701 nt, Artificial Sequence
  derived and/or modified sequence opt5 from hemagglutinin__InfluenzaA__AAZ32949
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcgaggccuauuccaauuguuacccuuaugacgugcccgauuacgcuucucuccggagccugaucgccuccagcggaacgcuugaauuuaccaacgagucuuucaauuggacaggcguuacccagaacggcacauccagcgcuugcaaacgcagaucuaauaaguccuuuuucagccggcugaacuggcucacccaucugaaguauaaauacccugcccuuaaugugacgaugcccaacaaugagaaguuugacaaacuguauauuuggggaguccaccauccugggacagauucugaccagaucucccucuacgcgcaggccagcggccgcauuaccguguccacaaagagaucucaacagaccguuaucccgaacauugggagccggccccgcgugagagauaucuccagccggaucucuauuuacuggaccaucgucaaaccuggagacauucugcugaucaacuccacaggcaaucucauugcuccccgcggguauuucaagaucagaagcggaaagucuagcaucaugcgguccgacgccccuauuggcaaauguaacucugaaugcaucacgcccaauggcagcauuccgaacgauaagccuuuucagaauaucaaccgcauuaccuacggggcuugucccagauaugugaaacagaauacacugaagcuggccaccggaaugcggaacgugccugagaaacaaacacgcggcaucuucggggcgaucgccggauuuauugaaaauggcugggaggggauggucgacggaugguacggcuucagacaccagaacuccgagggcaccgggcaggcugccgaucuuaagagcacgcaagcugccaucaaucagauuaacggaaaacucaaucggcugaucggcaagacaaacgaaaaguuucaccagauugagaaagaguucucugaaguugaagggagaauccaggaccuugagaaguauguggaggauaccaaaauugaccugugguccuacaaugccgaacuccugguggcucuggagaaccaacauaccaucgaucucacagacagcgaaaugaacaagcuguucgagcgcaccaaaaagcagcuucgggaaaaugcggaggauaugggaaacggcugcuuuaagaucuaucacaaaugugacaaugccugcauugggucuaucagaaacggcacauacgaucaugacgucuaccgcgacgaggcucugaauaaccgguuccagauuaagggaguggaacucaaauccggcuauaaggauuggauccuguggauuagcuuugccaucuccugcuuccuucuguguguugugcuccugggguuuaucaugugggccugccagaaaggaaauauuagauguaacaucugcauuuga

SEQ ID NO: 183252 - RNA, 1701 nt, Artificial Sequence
  derived and/or modified sequence opt5 from hemagglutinin__InfluenzaA__AAZ32950
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcgaggccuauuccaauuguuacccuuaugacgugcccgauuacgcuucucuccggagccugaucgccuccagcggaacgcuugaauuuaccaacgagucuuucaauuggacaggcguuacccagaacggcacauccagcgcuugcaaacgcagaucuaauaaguccuuuuucagccggcugaacuggcucacccaucugaaguauaaauacccugcccuuaaugugacgaugcccaacaaugagaaguuugacaaacuguauauuuggggaguccaccauccugggacagauucugaccagaucucccucuacgcgcaggccagcggccgcauuaccguguccacaaagagaucucaacagaccguuaucccgaacauugggagccggccccgcgugagagaugucuccagccggaucucuaucuacuggaccauugugaaaccuggagacauccugcugauuaacuccacaggcaaucucaucgcuccccgcggguauuucaagauuagaagcggaaagucuagcaucaugcgguccgacgccccuaucggcaaauguaacucugaaugcauuacgcccaauggcagcaucccgaacgauaagccuuuucagaauauuaaccgcaucaccuacggggcuugucccagauaugugaaacagaauacacugaagcuggccaccggaaugcggaacgucccugagaaacaaacacgcggcauuuucggggcgaucgccggauuuaucgaaaauggcugggaggggaugguugacggaugguacggcuucagacaccagaacuccgagggcaccgggcaggcugccgaucuuaagagcacgcaagcugccauuaaucagaucaacggaaaacucaaucggcugauuggcaagacaaacgaaaaguuucaccagaucgagaaagaguucucugaaguggaagggcgcauucaggaccuugagaaguauguggaggauaccaaaaucgaccugugguccuacaaugccgaacuccuggucgcucuggagaaccaacauaccauugaucucacagacagcgaaaugaacaagcuguucgagagaaccaaagaacagcuucgggagaaugcggaggauaugggaaacggcugcuuuaagaucuaucacaagugugacaaugccugcaucgggucuauuagaaacggcacauacgaucaugacguguaccgcgacgaagcucugaauaaccgguuccagaucaaaggaguugagcucaaguccggcuauaaagauuggauucuguggaucagcuuugccauuuccugcuuccuucugugugugguccuccugggguuuaucaugugggccugccagaagggaaauaucagauguaacauuugcaucuga

SEQ ID NO: 183253 - RNA, 1701 nt, Artificial Sequence
  derived and/or modified sequence opt5 from hemagglutinin__InfluenzaA__AAZ32951
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccauugcgacggguuucagaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacaaaauggcaccuccagcgcuugcaagcgcagaucuaacaaguccuuuuucagccggcugaauuggcuccaccagcugaaauauaaguacccugcccuuaacgucgcgaugcccaauaacgagaaauuugacaagcuguauaucuggggagugcaucacccugggacagauucugaccagauuucccucuacgcccaggcuagcggccgcaucaccguuuccacgaaaagaucucaacagacagugauuccgaacaucgggagccggccccgcgucagagauauuuccagccggaucucuaucuacuggaccauugugaagccuggagacauccugcugauuaauuccacaggcaaccucaucgcuccccgcggguauuucaagauuagaagcggaaaaucuagcaucaugcgguccgacgccccuaucggcaaguguaauucugagugcauuacccccaacggcagcaucccgaaugauaaaccuuuucagaacgugaaucgcauuaccuacggggccugucccagauaugucaagcagaacacacugaaacuugcgacgggaaugcggaauguuccugaaaagcaaacccgcggcaucuucggggccauugcuggauuuaucgagaacggcugggaagggaugguggacggaugguacggcuucagacaccaaaauuccgagggcacagggcaggccgcugaucugaaaagcacccaggccgccaucaaccagauuaauggaaagcucaaccggcugaucggcaagacaaaugagaaauuucaucagauugaaaaggaguucucugaaguggaggggagaauccaggaccuugaaaaauaugucgaggauaccaagauugaccugugguccuacaacgcugagcuccugguggcgcuggaaaaccaacacacgaucgaucucacagacagcgagaugaauaaacuguucgaacgcaccaagaagcagcuucgggagaacgccgaagauaugggaaauggcugcuuuaaaauuuaucauaagugugacaacgcuugcaucgggucuaucagaaauggcaccuacgaucacgacguuuaccgcgacgaggcccugaacaaucgguuccagauuaaaggaguggagcucaaguccggcuauaaagauuggauccuguggauuagcuuugccaucuccugcuuccuucugugugucgcucuccugggguuuauuaugugggccugccagaagggaaacaucagauguaauaucugcauuuga

SEQ ID NO: 183254 - RNA, 1701 nt, Artificial Sequence
  derived and/or modified sequence opt5 from hemagglutinin__InfluenzaA__AAZ32952
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccauugcgacggguuucagaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacaaaauggcaccuccagcgcuugcaagcgcagaucuaacaaguccuuuuucagccggcugaauuggcuccaccagcugaaauauaaguacccugcccuuaacgucgcgaugcccaauaacgagaaauuugacaagcuguauaucuggggagugcaucacccugggacagauucugaccagauuucccucuacgcccaggcuagcggccgcaucaccguuuccacgaaaagaucucaacagacagugauuccgaacaucgggagccggccccgcgucagagauguguccagccggauuucuaucuacuggaccaucgugaagccuggagacauucugcugaucaauuccacaggcaaccucauugcuccccgcggguauuucaagaucagaagcggaaaaucuagcauuaugcgguccgacgccccuaucggcaaguguaauucugagugcaucacccccaacggcagcauuccgaaugauaaaccuuuucagaacgucaauaagaucaccuacggggccuguccccgcuauguuaaacagaacacacugaagcuggcgacgggaaugagaaaugugccugaaaaacaaacccggggcauuuucggggccaucgcuggauuuauugagaacggcugggaagggaugguggacggaugguacggcuuccgccaccaaaauuccgagggcacagggcaggccgcugaucuuaagagcacccaggccgccaucaaccagaucaauggaaagcucaacagacugauuggcaaaacaaaugagaaguuucaucagaucgaaaaagaguucucugaagucgaggggcggauucaggaccuugaaaaguauguggaggauaccaaaaucgaccugugguccuacaacgcugagcuccugguugcgcuggaaaaccaacacacgauugaucucacagacagcgagaugaauaagcuguucgaaagaaccaagaaacagcuucgcgagaacgccgaagauaugggaaauggcugcuuuaagaucuaucauaaaugugacaacgcuugcauugggucuauccggaauggcaccuacgaucacgacguguacagagacgaggcccugaacaaucgcuuccagaucaagggagucgagcucaaauccggcuauaaggauuggauucuguggaucagcuuugccauuuccugcuuccuucuguguguggcucuccugggguuuaucaugugggccugccagaagggaaacauucgguguaauaucugcaucuga

SEQ ID NO: 183255 - RNA, 1701 nt, Artificial Sequence
  derived and/or modified sequence opt5 from hemagglutinin__InfluenzaA__AAZ32953
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccauugcgacggguuucagaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacaaaauggcaccuccagcgcuugcaagcgcagaucuaacaaguccuuuuucagccggcugaauuggcuccaccagcugaaauauaaguacccugcccuuaacgucgcgaugcccaauaacgagaaauuugacaagcuguauaucuggggagugcaucacccugggacagauucugaccagauuucccucuacgcccaggcuagcggccgcaucaccguuuccacgaaaagaucucaacagacagugauuccgaacaucgggagccggccccgcgucagagauguguccagccggauuucuaucuacuggaccaucgugaagccuggagacauucugcugaucaauuccacaggcaaccucauugcccccagaggguauuucaagaucagaagcggaaaaucuagcauuaugcgguccgacgcuccuaucggcaaguguaauucugagugcaucacccccaacggcagcauuccgaaugauaaaccuuuucagaacgucaaucgcaucaccuacggggccugucccagauauguuaagcagaacacacugaaacuugcgacgggaaugcggaaugugccugaaaagcaaacccgcggcauuuucggggccaucgcuggauuuauugagaacggcugggaagggaugguggacggaugguacggcuucagacaccaaaauuccgagggcacagggcaggccgcugaucugaaaagcacccaggccgccaucaaccagaucaauggaaagcucaaccggcugauuggcaagacaaaugagaaauuucaucagaucgaaaaggaguucucugaagucgaggggcgcauucaggaccuugaaaaauauguggaggauaccaagaucgaccugugguccuacaacgcugagcuccugguugcgcuggaaaaccaacacacgauugaucucacagacagcgagaugaauaaacuguucgaacgcaccaagaagcagcuucgggagaacgccgaagauaugggaaauggcugcuuuaaaaucuaucauaagugugacaacgcuugcauugggucuaucagaaauggcaccuacgaucacgacguguaccgcgacgaggcccugaacaaucgguuccagaucaaaggagucgagcucaaguccggcuauaaagauuggauucuguggaucagcuuugccauuuccugcuuccuucuguguguggcucuccugggguuuaucaugugggccugccagaagggaaacauuagauguaauaucugcaucuga

SEQ ID NO: 183256 - RNA, 1701 nt, Artificial Sequence
  derived and/or modified sequence opt5 from hemagglutinin__InfluenzaA__AAZ38462
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucacaaugcccaauaacgacaaguucgauaaacucuauaucuggggcgugcauuacccugggacagacucugaucagaccucccuguacgcccaggcuagcggacggguuacgguguccacaaagcgcucucagcaaaccgucauuccgaauaucggcagcagacccugggugcgcgggguguccagccggauuucuaucuauuggacaauugucaaaccuggagacauccugcucaucaacuccaccggcaaccugauugcccccagaggguacuuuaagauccggagcggaaagucuagcauuaugcgcuccgacgcuccuaucggcaaauguaauucugagugcauuacccccaacggcagcaucccgaaugggaagccuuuccagaacguuaauagaaucacauauggagccuguccccgguacgugaaacagaacacgcuuaagcuggcgaccggcaugcgcaaugugccugaaaaacagacaagagggauuuuuggagccaucgcuggcuucauugagaacgggugggaaggaauggucgauggcugguauggcuuucggcaccaaaauuccgaggggaccggacaggccgcugaccucaagagcacacaggccgccaucaaccaaauuaauggcaaacugaacagacuuaucgagaagaccaaugaaaaguuccaccagaucgagaaagaguucacggaaguggaagggcgcauucaggaucuggagaaguacguugaggacacaaaaaucgaucucuggucuuauaacgcugaacugcugguggcgcucgagaaucagcauaccauugaccugaccgauuccgaaaugaacaaacuuuuugagcggacaagacgccaacugcgggaaaacgccgaggacaugggaaauggcugcuucaagaucuaccacaagugugauaacgcuugcauugggagcaucagaaauggcaccuacgaccaugaugucuaucgcgacgaggcccucaacaaucgguuucagauuaagggaguggaacugaaaucuggcuacaaggacuggauccuuuggaucuccuucgccacaagcugcuuucugcucuguguugugcugcugggguucauuaugugggcuugccagaaaggaaacaucagauguaauauuugcaucuga

SEQ ID NO: 183257 - RNA, 1701 nt, Artificial Sequence
  derived and/or modified sequence opt5 from hemagglutinin__InfluenzaA__AAZ38473
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuuacaugcaaacggcgcucuauuaaguccuucuuuagcagacucaauuggcugcaccaacuuaaguauaaauacccugcccugaacgucacaaugcccaauaacgacaaguucgauaaacucuauaucuggggcgugcaucacccuucuaccgacuccgaucagacgagccuguacgcgcaggccuccgggcggguuacagugucuaccaagcgcagccagcaaacagucauuccgaauaucggauccagacccugggugcggggcgugagcucucgcauuuccaucuacuggaccauugucaaaccuggggacauccugcucaucaacagcaccggaaaccugauugcucccagaggcuauuuuaagauccggucuggaaagagcuccauuaugaaaucugacgccccuaucgggaaguguaauagcgagugcauuacacccaacggcuccaucccgaaugauaaaccuuuccagaacguuaaucgcaucacguacggcgcuugucccagauaugugaagcagaacacccuuaaacuggccacagggaugcggaaugugccugaaaagcagacccgcggaauuuuuggcgcgaucgccggguucauugagaacggaugggaaggcauggucgacgggugguacggauuuagacaccaaaauagcgagggcacaggccaggcugccgaucucaaaucuacccaggcugccaucaaccaaauuaaugggaagcugaaccggcuuaucgagaagacgaaugaaaaauuccaucagaucgagaaggaguucacagaaguggaaggacgcauucaggaccuggagaaauauguugaggauaccaagaucgaccucugguccuacaacgccgaacugcugguggcucucgagaaucagcacaccauugaucugacagacagcgaaaugaacaaacuuuuugagagaacccggaagcaacugagagaaaacgcggaggauaugggcaaugggugcuucaagaucuaucauaaaugugacaacgucugcauuggaucuauccgcaauggcacauacgaucacgacguguaccgggacgaggcccucaacaauagauuucagauuaaggggguugaacugaaauccggcuauaaggauuggauccuuuggaucagcuucgcuacguccugcuuucugcucugugugguccugcugggauucauuaugugggccugccagaaaggcaacauccgcuguaauauuugcaucuga

SEQ ID NO: 183258 - RNA, 1701 nt, Artificial Sequence; identical to SEQ ID NO: 183210
  derived and/or modified sequence opt5 from hemagglutinin__InfluenzaA__AAZ38484

SEQ ID NO: 183259 - RNA, 1701 nt, Artificial Sequence
  derived and/or modified sequence opt5 from hemagglutinin__InfluenzaA__AAZ38495
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucuaaaauuuccaucuacuggaccauugucaagccuggggauauccugcucaucaauagcacaggaaaccugauugcuccccggggcuauuucaagauccgcucugggaaaagcuccauuaugagaucugacgccccuaucggaaaguguaauagcgaaugcauuacccccaacggcuccaucccgaaugacaaaccuuuucagaacguuaaucggaucaccuacggcgccuguccccgcuaugugaagcagaacacacuuaaacuggcgacggggaugagaaaugugccugagaagcaaacccggggaauuuucggcgccaucgcuggguuuauugaaaacggaugggagggcauggucgaugggugguacggauuccgccaccagaauagcgagggcacaggccaggccgcugaccucaaaucuacccaagccgccaucaaccagauuaaugggaagcugaacagacuuaucgaaaagacaaaugagaaauuucaucagaucgaaaaggaguucuccgaaguggagggacggauucaggaucuggagaaauauguugaagacaccaagaucgaucucuggagcuacaacgcugagcugcugguggcgcucgaaaaccaacacacgauugaccugacagauucugagaugaauaaacuuuucgaaagaaccaagaagcagcugcgcgagaacgccgaggacaugggcaaugggugcuuuaaaaucuaucauaagugugauaacgcuugcauuggauccauccggaauggcaccuacgaccacgaugucuacagagacgaagcccucaacaaucgcuuccagauuaaagggguggagcuuaagagcggcuauaaagacuggauccuguggaucuccuuugccauuucuugcuuccugcucuguguugugcugcugggauuuaucaugugggcuugccagaagggcaacauucgguguaauaucugcauuuga

SEQ ID NO: 183260 - RNA, 1701 nt, Artificial Sequence
  derived and/or modified sequence opt5 from hemagglutinin__InfluenzaA__AAZ38517
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacaauugaucucaccgacucugagaugaauaagcuguuugaaagaaccaaaaagcagcuucgggagaacgcggaagauaugggaaauggcugcuucaagaucuaccacaaauguaacaaugccugcaucggguccauuagaaacggcacauaugaccaugauguuuaccgcgacgaggcucugaauaaccgguuucagaucaagggaguggagcucaaaagcggcuacaaggacuggauucuguggaucucuuucgccauuuccugcuuucuucugugugucgugcuccugggguucaucaugugggccugccagaaaggaaauaucagauguaacauuugcaucuga

SEQ ID NO: 183261 - RNA, 1701 nt, Artificial Sequence
  derived and/or modified sequence opt5 from hemagglutinin__InfluenzaA__AAZ38539
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagcaaaauuucuaucuacuggaccauuguuaagccuggagacaucuuccugaucaacuccacaggcaaucucauugcuccccggggguauuuuaagauccgcagcggaaaaucuagcauuaugagauccgacgccccuaucggcaaguguaacucugaaugcauuacccccaauggcagcaucccgaacgauaaaccuuuccagaaugugaaccggaucaccuacgggcccuguccucgcuaugugaagcagaauacacugaaacuugcuacgggaaugagaaacguccccgagaagcaaacccggggcauuuuuggggccaucgcgggauucauugaaaauggcugggaggggaugauggacggaugguacggcuuucgccaccagaacuccgagggcacagggcaggccgcugaucugaaaagcacccaagccgcuaucaaucagauuaacggaaagcucaauagacugaucgaaaagacaaacgagaaauuccaucagaucgaaaaggaguucucugaaguggagggccggauucaggaccuugagaaauauguugaagauaccaagaucgaccugugguccuacaaugccgagcuccugguggcccuggaaaaccaacacacgauugaucucacagacagcgagaugaacaaacuguuugaaagaaccaagaagcagcuucgcgagaaugcugaggauauggggaacggaugcuucaaaaucuaucauaagugugacaaugcgugcauuggcucuauccggaacgggaccuacgaucacgacgucuacagagacgaagcccugaauaaccgcuuucagauuaaaggcguggagcucaaguccggauauaaagauuggauccuguggaucagcuucgcuauuuccugcuuucuucuguguaucguucuccugggcuucauuaugugggccugccagaaggggaauauccgguguaacauuugcaucuga

SEQ ID NO: 183262 - RNA, 1701 nt, Artificial Sequence; identical to SEQ ID NO: 183210
  derived and/or modified sequence opt5 from hemagglutinin__InfluenzaA__AAZ38561

SEQ ID NO: 183263 - RNA, 1701 nt, Artificial Sequence
  derived and/or modified sequence opt5 from hemagglutinin__InfluenzaA__AAZ38583
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucaacuggaccggcgugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggagugcaccauccugggacgaauaacgaucagaucucucuguaugcgcaggccuccggccgcauuacaguuagcaccaagagaucccaacagacagugaucccgaauauugggucucggccccgcgucagagacaucccuagccggaucuccauuuacuggaccaucgugaaacccggagauauucuccugaucaacagcaccggcaaucugauugcuccucgcggguacuuuaagaucagaucuggaaaguccagcaucaugcggucugacgcccccauuggcaaauguaacagcgagugcaucacaccgaauggcuccauuccuaacgacaagcccuuccagaaugugaaccgcaucacguauggggcuuguccuagauacgucaaacagaauacccucaagcuggccacaggaaugcggaacguucccgaaaaacaaacccgcggcauuuuuggggcgaucgccggauucaucgagaauggcugggaagggaugguggauggaugguauggcuuuagacaccagaacucugagggcauugggcaggcugccgaccuuaagagcacacaagcugccaucaaucagauuaacggaaaacugaaccggcucaucggcaagaccaaugagaaguuccaccagauugaaaaagaguucuccgaaguggaggggagaauccaggaucuggaaaaguacgucgaggacacgaaaauugaucuuuggagcuauaacgccgagcugcucguggcucuggaaaaucaacauacaaucgaccugaccgauucugagaugaacaagcucuuugaacgcaccaaaaagcagcugcgggagaaugcggaagacaugggaaacggcugcuucaagaucuaccacaaaugugauaaugccugcauuggguccaucagaaacggcacauaugaccaugauguuuaccgcgacgaggcucuuaauaaccgguuucagauuaagggaguggagcugaaaagcggcuacaaggacuggaucauuuggaucucuuucgccaucuccugcuuucuccugugugucgcccuucugggguucauuaugugggcuugccagaaaggaaauaucagauguaacauuugcaucuga

SEQ ID NO: 183264 - RNA, 1701 nt, Artificial Sequence
  derived and/or modified sequence opt5 from hemagglutinin__InfluenzaA__AAZ38594
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacuccagcuuuuucucucggcugaauuggcucacacaucugaaguuuaaauauccugcccuuaacgucaccaugcccaauaacgagaaguucgacaaacuguacaucuggggagugcaccauccugggacggauaacgaccagauuucccucuaugcgcaggccagcggccgcaucacaguuuccaccaagagaucucaacagacagugauuccgaauaucgggagccggccccgcgucagagauauuccuucccggaucagcaucuacuggaccauugugaaacccggagacauccugcugauuaacucuaccggcaaucucaucgcuccucgcggguacuuuaagauuagauccggaaagagcucuaucaugcggagcgacgcccccaucggcaaauguaacuccgagugcauuacaccgaauggcucuaucccuaacgauaagcccuuccagaaugugaaccgcauuacguauggggcuuguccuagauacgucaaacagaauacccugaaacuugccacaggaaugcggaacguucccgaaaagcaaacccgcggcaucuuuggggcgauugccggauucaucgagaauggcugggaagggaugguggacggaugguauggcuuuagacaccagaacagcgagggcaucgggcaggcugccgaucugaaguccacacaagcugccauuaaucagaucaacggaaaacucaaucggcugauuggcaagaccaacgagaaguuccaccagaucgaaaaagaguucagcgaaguggaggggcgcauucaggaccuugaaaaguacgucgaggauacgaaaaucgaccuguggucuuauaacgccgagcuccugguggcucuggaaaaucaacauacaauugaucucaccgacuccgagaugaacaagcuguuugaaagaaccaaaaagcagcuucgggagaaugcggaagauaugggaaacggcugcuucaagaucuaccacaaaugugacaaugccugcaucgggagcauuagaaacggcacauaugaucaugacguuuaccgcgacgaggcucugaauaaccgguuucagaucaagggaguggagcucaaaucuggcuacaaggauuggauucuguggaucuccuucgccauuagcugcuuucuucugugugucgcccuccugggguucaucaugugggcuugccagaaaggaaauaucagauguaacauuugcaucuga

SEQ ID NO: 183265 - RNA, 1701 nt, Artificial Sequence
  derived and/or modified sequence opt5 from hemagglutinin__InfluenzaA__AAZ38605
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgggaucugcgacucuccgcaccagauccuugauggagagaauuguacgcugauugacgcucuccugggcgauccccagugcgacggguuucaaaacaaaaagugggaucuguucgucgaaagaagcaaagccuauuccaauuguuacccuuaugacgugcccgauuacgccucucuccggagccugguugcuuccagcggaacccuugaguuuaacaaugaaucuuucaacuggacaggcgugacccagaauggcacauccagcgccugcaagcgcagaucuaacaauuccuuuuucagccggcugaacuggcucacccaucugaaguuuaaauauccugcucuuaaugucacgaugcccaacaacgagaaguucgacaaacuguacaucuggggagugcaccauccugggacagauaaugaccagauuucucucuaugcccaggcguccggccgcaucaccguuagcacaaagagaucccaacagaccgugauuccgucuaucgggagccggccccgcauuagagaugucccuucccggaucagcaucuacuggaccauugugaaacccggagacauccugcugauuaacucuacaggcaaucucaucgccccucgcggguacuuuaagauuagauccggaaagagcucuaucaugcggagcgacgcucccaucggcaaauguaacuccgagugcauuacgccgaauggcucuaucccuaacgauaagcccuuccagaaugugaaccgcauuaccuauggggccuguccuagauacgucaaacagaauacacugaaacuugcuaccggaaugcggaacguucccgaaaagcaaacacgcggcaucuuuggggccauugcgggauucaucgagaauggcugggaagggaugguggacggaugguauggcuuuagacaccagaacagcgagggcaccgggcaggccgcugaucugaaguccacgcaagccgcuaucaaucagauuaacggaaaacucaaucggcugaucggcaagacaaacgagaaguuccaccagauugaaaaagaguucagcgaaguggaggggagaauccaggaccuugaaaaguacgucgaggauaccaaaauugaccuguggucuuauaacgccgagcuccugguggcccuggaaaaucaacauaccaucgaucucacagacuccgagaugaacaagcuguuugaacgcaccaaaaagcagcuucgggagaaugcugaagauaugggaaacggcugcuucaagauuuaccacaaaugugacaaugcgugcaucgggagcaucagaaacggcacauaugaucaugacguuuaccgcgacgaggcccugaauaaccgguuucagauuaagggaguggagcucaaaucuggcuacaaggauuggauccuguggauuuccuucgcuaucagcugcuuucuucugugugucgcccuccugggguucauuaugugggccugccagaaaggaaauaucagauguaacaucugcauuuga

SEQ ID NO: 183266 - RNA, 1698 nt, Artificial Sequence
  derived and/or modified sequence opt5 from hemagglutinin__InfluenzaA__AAZ38627
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucugccaaacugcgcauggcuaccggccucagaaauauucccagcauccagucccgggggcuguuuggagccauugcuggcuucaucgaagggggauggacaggcaugguugacggcugguauggguaccaucaccagaacgaacaaggaucuggcuacgccgccgaucaaaagagcacgcagaaugcuauuaacgggaucaccaauaaagugaacuccgucaucgagaagaugaauacacaguuuaccgcggugggaaaagaguucaacaagcuggagcgcagaauggagaaucucaacaaaaagguugacgauggcuuccuggacauuuggacauauaacgccgaacuucuggugcuccuggagaaugaacggacccuugacuuucacgauagcaacgucaagaaucuguacgagaaagugaagucucagcucaaaaacaaugcuaaggaaaucgggaacggcugcuucgaguuuuaucauaaauguaauaacgagugcauggaauccgucaagaauggaacguacgacuaucccaaguacagcgaggaaucuaaacugaaccgcgagaagauugauggcgugaaacuggaguccauggggguuuaucagauccucgccauuuacagcacaguggccuccucucugguccuucuggugagccucggagcuaucuccuucuggaugugcucuaauggcagccugcaguguagaaucugcauuuga

SEQ ID NO: 183267 - RNA, 1701 nt, Artificial Sequence
  derived and/or modified sequence opt5 from hemagglutinin__InfluenzaA__AAZ38638
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacaauugaucucaccgacucugagaugaauaagcuguuugaaagaaccaaaaagcagcuucgggagaacgcggaagauaugggaaauggcugcuucaagaucuaccacaaaugugacaacgccugcaucggguccauuagaaauggcacauaugaucaugacguuuaccgcgacgaggcucugaacaaucgguuucagaucaagggaguggagcucaaaagcggcuacaaggauuggauucuguggaucucuuucgccauuuccugcuuucuucugugugucgcccuccugggguucaucaugugggcuugccagaaaggaaacaucagauguaauauuugcaucuga

SEQ ID NO: 183268 - RNA, 1701 nt, Artificial Sequence; identical to SEQ ID NO: 183267
  derived and/or modified sequence opt5 from hemagglutinin__InfluenzaA__AAZ38650

SEQ ID NO: 183269 - RNA, 1701 nt, Artificial Sequence
  derived and/or modified sequence opt5 from hemagglutinin__InfluenzaA__AAZ43370
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuuauugaacgcagcaaagccuucuccaauuguuauccuuacgacguccccgauuaugcuucucucagaagccugguggccuccagcgggacgcuugaguuuaucaacgaaggauucaauuggaccggcguuacacagucuggcggguccuacgcuugcaagcggggaagcgugaaguccuuuuucucucgccugaacuggcucuaugagagcgaguacaaauauccugcccugaaugucaccaugcccaacaauggcaaguuugacaaacuuuacauuuggggagugcaccauccuucuacagaaaaggagcaaaccaaccuguacguuagagcguccgggcgggugacggucagcacaaaacgcucccagcagaccgugaucccgaauauuggcucuagacccugggugcgggggcucagcucccgcaucagcauuuauuggacaaucgucaagccuggagauauccugcugauuaacucuaccggcaaccucaucgcccccagaggcuacuucaagauucggaccgggaaauccagcaucaugcgcucugacgcuccuauuggaacauguagcuccgaaugcaucacgcccaauggcucuaucccgaacgauaagccuuuucagaauguuaacaaaauuaccuauggggccugucccagauacgugaagcaaaauacacugaaacuugcuaccggaaugcggaacgugccugagaagcagacacgcggcaucuucggggccauugcgggauuuaucgagaauggcugggaaggcauggucgacgggugguauggauucagacaccagaacagcgagggcaccgggcaggccgcugaccugaaauccacgcaagccgcuauugaucagaucaauggaaagcucaaccggcugaucgaaaagacaaaugagaaauuccaccagauugaaaaggaguuuagcgagguggaaggcagaauccaagaccuugagaaauacguugaagauaccaagauugaccuguggucuuauaacgccgagcuccugguggcccuggaaaaucagcauaccaucgaucucacagacuccgagaugaacaaacuguucgagaagacccgcaagcagcuucgggaaaaugcugaggauauggggaacggcugcuuuaaaauuuaccacaagugugacaacgcgugcaucggaagcauuagaaauggcacauacgaucaugacgucuaucgcgaugaagcccugaacaaucgguuccagaucaaagggguggagcucaagucuggauacaaagacuggauccuguggauuuccuuugcuaucagcugcuuccuucuguguguugugcuccugggcuuuauuaugugggccugccaaaaggggaacaucagauguaauauuugcaucuga

SEQ ID NO: 183270 - RNA, 1701 nt, Artificial Sequence; identical to SEQ ID NO: 183142
  derived and/or modified sequence opt5 from hemagglutinin__InfluenzaA__AAZ43394

SEQ ID NO: 183271 - RNA, 1701 nt, Artificial Sequence
  derived and/or modified sequence opt5 from hemagglutinin__InfluenzaA__AAZ43405
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauuguacaggaaaccugauugcccccagaggcuauuucaagaucagaagcgggaagucuagcauuaugcgguccgacgcuucuaucggaaaaugcaauagcgaauguauuaccccuaacggcuccauccccaaugacaagccguuucagaacguuaaucgcaucaccuacggcgccugcccuagauaugugaaacagaacacacuuaagcuggcgacggggaugcggaaugugcccgagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaauggguguuuuaagaucuaucauaaaugcgauaacgcuugcauuggauccaucagaaauggcaccuacgaccacgaugucuaccgcgacgaagcccucaacaaucgguuccagauuaaggggguggagcugaaaagcggcuauaaggacuggauccuuuggaucuccuuugccauuucuuguuuccugcucugcguugugcugcugggauuuaucaugugggcuugucagaaaggcaacauuagaugcaauaucuguauuuga

SEQ ID NO: 183272 - RNA, 1701 nt, Artificial Sequence; identical to SEQ ID NO: 183071
  derived and/or modified sequence opt5 from hemagglutinin__InfluenzaA__AAZ74352

SEQ ID NO: 183273 - RNA, 1701 nt, Artificial Sequence; identical to SEQ ID NO: 183227
  derived and/or modified sequence opt5 from hemagglutinin__InfluenzaA__AAZ74363

SEQ ID NO: 183274 - RNA, 1698 nt, Artificial Sequence
  derived and/or modified sequence opt5 from hemagglutinin__InfluenzaA__AAZ74374
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcgaucagagaacccuguaccacacagaaaacgcuuaugucagcgugguguccucucauuacgggcggcgcuucacccccgagauuacgaaaagaccuaagguccgggaccaggaaggacgcaucaauuauuacuggacacuucuggagcccggcgauaccauuaucuuugaggccaacgggaaucucauugcgccuugguaugccuucgcucugagcagaggauuuggcuccggcaucaucacaagcaacgcccccauggacgaaugugaugcuaagugccagaccccgcaaggggccauuaauucuucccuuccuuuccagaacguucaccccgugaccaucggagaguguccuaaauacgugcggagcgcgaagcugcgcauggucacaggccucagaaauauucccucuauccagagccgggggcuguuuggagccauugcuggcuucaucgaagggggauggacgggcaugguggacggcugguauggguaccaucaccagaacgagcaaggauccggcuacgccgcugaucagaaaucuacccagaaugccaucaacgggauuacaaauaagguuaacagcgugaucgaaaagaugaauacccaguuuacagccgucggaaaagaguucaacaaacuggagcgcagaauggaaaaucucaacaagaagguggacgauggcuuccuggacguuuggaccuauaacgcugagcuucuggugcuccuggaaaaugagcggacgcuugacuuucacgauuccaacgucaaaaaucuguacgaaaaggugaaaagccaacucaagaacaaugcgaaagagauugggaacggcugcuucgaguuuuaucauaaguguaauaacgaaugcauggagucugucaagaauggaacauacgacuaucccaaauacuccgaagagagcaagcugaaccgcgagaaaaucgauggcgugaagcuggacucuauggggguuuaucagauucucgccaucuacuccaccguggcuagcucccugguccuucuggugucucucggagccaucagcuucuggaugugcuccaauggcucucugcaguguagaauuugcaucuga

SEQ ID NO: 183275 - RNA, 1701 nt, Artificial Sequence
  derived and/or modified sequence opt5 from hemagglutinin__InfluenzaA__AAZ74397
augaacaccaucauugcccugagcuacauccucugccugguguucgcucagaaacuucccggcaaugacaacuccacagccacgcugugucucgggcaccaugcggucccuaauggaacccugguuaagacaauuaccucugaucaaaucgaggugacaaacgcuaccgaacuugugcagagcuccucuacaggcagaauuugcgacagcccgcaccggauccuggauggggagaauuguacccucaucgacgcccugcugggagauccccucugcgacggcuuucagaacaaggaaugggaucuguucgucgagcgcuccaaagccuauucuaauuguuacccuuaugacgugcccgauuacgcuagccuuagaucccugguugccagcucugggacgcucgaauuuaacaaugaguccuucaacuggaccggaguggcucagaauggcaccagcuuugccugcaagcggcgcucuauuaaauccuucuuuagcagacugaacuggcuucaucaacugaaguauaaguacccugcgcucaaugucacaaugcccaacaaugacaaauucgauaagcuguauaucuggggcgugcaccauccugggacagacucugaucagaccucccuguacgcccaggcuagcggacggguuacgguguccacaaaacgcucucagcaaaccgucauuccgaacaucggcagcagacccugggugcgcgggguguccagccggauuucuaucuacuggacaauugucaagccuggagacauccuccugaucaacuccaccggcaaucuuauugcccccagaggguauuuuaaaauccggagcggaaagucuagcauuaugcgcuccgacgcuccuaucggcaaguguaacucugagugcauuacccccaauggcagcaucccgaacgggaaaccuuuccagaauguuaacagaaucacauacggagccuguccccgguaugugaagcagaauacgcugaaacucgcgaccggcaugcgcaacgugccugaaaagcagacaagagggauuuuuggagccaucgcuggcuucauugagaaugggugggaaggaauggucgauggcugguacggcuuucggcaccaaaacuccgaggggaccggacaggccgcugaccugaaaagcacacaggccgccaucaaucaaauuaacggcaaacuuaauagacugaucgagaagaccaacgaaaaguuccaccagaucgagaaggaguucacggaaguggaagggcgcauucaggaucucgagaaauauguugaggacacaaagaucgaucuguggucuuacaaugcugaacugcucguggcgcuggagaaccagcauaccauugaccuuaccgauuccgaaaugaacaaacuguuugagcggacaagaaagcaacuccgcgaaaaugccgaggacaugggaaacggcugcuucaaaaucuaucacaagugugauaaugcuugcauugggagcauccggaacggcaccuacgaccaugaugucuacagagacgaggcccugaauaaccgcuuucagauuaagggaguggaacuuaaaucuggcuauaaggacuggauccuguggaucuccuucgccacaagcugcuuucuccuguguguugugcugcucggguucauuaugugggcuugccagaaaggaaauauccgguguaacauuugcaucuga

SEQ ID NO: 183276 - RNA, 1701 nt, Artificial Sequence
  derived and/or modified sequence opt5 from hemagglutinin__InfluenzaA__AAZ74408
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcauuggauccaucagaaauggcaccuacaaccacgacgucuaccgcgaugaagcccucaauaaccgguuccagauuaaggggguggagcugaaaagcggcuauaaggacuggauccuuuggaucuccuuugccauuucuugcuuccugcucuguguugugcugcugggauuuaucaugugggcuugccagaaaggcaauauuagauguaacaucugcauuuga

SEQ ID NO: 183277 - RNA, 1701 nt, Artificial Sequence; identical to SEQ ID NO: 183210
  derived and/or modified sequence opt5 from hemagglutinin__InfluenzaA__AAZ74430

SEQ ID NO: 183278 - RNA, 1701 nt, Artificial Sequence; identical to SEQ ID NO: 183267
  derived and/or modified sequence opt5 from hemagglutinin__InfluenzaA__AAZ74441

SEQ ID NO: 183279 - RNA, 1701 nt, Artificial Sequence
  derived and/or modified sequence opt5 from hemagglutinin__InfluenzaA__AAZ74452
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucaucgaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucccuagccggaucuccauuuacuggaccaucgucaaacccggagacauucugcugaucaauagcaccggcaaccucauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgugaaacagaacacccugaagcuggccacaggaaugcggaauguccccgaaaaacaaacccgcggcauuuuuggggcgaucgccggauucaucgagaacggcugggaagggaugguugacggaugguauggcuuuagacaccaaaauucugagggcauugggcaggcugccgaucuuaagagcacacaggcugccaucaaccagauuaauggaaaacucaaccggcugaucggcaagaccaacgagaaguuccaccagauugaaaaagaguucuccgaaguggaggggagaauccaggaccuugaaaaguacguggaggauacgaaaauugaccuguggagcuauaaugccgagcuccuggucgcucuggaaaaccaacauacaaucgaucucaccgacucugagaugaauaagcuguuugaacgcaccaaaaagcagcuucgggagaacgcggaagauaugggaaauggcugcuucaagaucuaccacaaaugugacaacgccugcauuggguccaucagaaauggcacauaugaucaugacguguaccgcgacgaggcucugaacaaucgguuucagauuaagggaguugagcucaaaagcggcuacaaggauuggauccuguggauuucuuucgccaucuccugcuuucuucuguguguggcccuccugggguucaucaugugggcuugccagaaaggaaacauuagauguaauaucugcauuuga

SEQ ID NO: 183280 - RNA, 1701 nt, Artificial Sequence
  derived and/or modified sequence opt5 from hemagglutinin__InfluenzaA__AAZ74463
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacaauugaucucaccgacucugagaugaauaagcuguuugaaagaaccaaaaagcagcuucgggagaacgcggaagauaugggaaauggcugcuucaagaucuaccacaaaugugacaacgccugcaucggguccauuagaaauggcacauaugaucaugacguuuaccgcgacgaggcucugaacaaucgguuucagaucaagggaguggagcucaaaagcggcuacaaggauuggauucuguggaucucuuucgccauuuccugcuuucuucugugugucgugcuccugggguucaucaugugggccugccagaaaggaaacaucagauguaauauuugcaucuga

SEQ ID NO: 183281 - RNA, 1701 nt, Artificial Sequence
  derived and/or modified sequence opt5 from hemagglutinin__InfluenzaA__AAZ74474
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagaagcgcucuaacaauuccuuuuucagcagacugaacuggcucacacaucugaaauuuaaguauccugcccuuaaugucaccaugcccaacaacgagaaauucgacaagcuguacaucuggggagugcaccauccugggacggauaaugaccagauuucucucuaugcgcaggccuccggccggaucacaguuagcaccaaacgcucccaacagacagugauuccgaacaucgggucuagaccccggguccgcgauauuccuagcagaaucuccaucuacuggaccauugugaagcccggagacauccugcugauuaauagcaccggcaaccucaucgcuccucggggguacuuuaagauucgcucuggaaaauccagcaucaugagaucugacgcccccaucggcaaguguaauagcgagugcauuacaccgaacggcuccaucccuaaugauaaacccuuccagaacgugaaucggauuacguauggggcuuguccucgcuacgucaagcagaacacccugaaacuugccacaggaaugagaaauguucccgaaaagcaaacccggggcaucuuuggggcgauugccggauucaucgagaacggcugggaagggaugguggacggaugguauggcuuucgccaccaaaauucugagggcaucgggcaggcugccgaucugaaaagcacacaggcugccauuaaccagaucaauggaaagcucaacagacugauuggcaagaccaacgagaaauuccaccagaucgaaaaggaguucuccgaaguggaggggcggauucaggaccuugaaaaauacgucgaggauacgaagaucgaccuguggagcuauaaugccgagcuccugguggcucuggaaaaccaacauacaauugaucucaccgacucugagaugaauaaacuguuugaaagaaccaagaagcagcuucgcgagaacgcggaagauaugggaaauggcugcuucaaaaucuaccacaagugugacaacgccugcaucggguccauucggaauggcacauaugaucaugacguuuacagagacgaggcucugaacaaucgcuuucagaucaaaggaguggagcucaagagcggcuacaaagauuggauucuguggaucucuuucgccauuuccugcuuucuucugugugucgcccuccugggguucaucaugugggcuugccagaagggaaacauccgguguaauauuugcaucuga

SEQ ID NO: 183282 - RNA, 1701 nt, Artificial Sequence; identical to SEQ ID NO: 183279
  derived and/or modified sequence opt5 from hemagglutinin__InfluenzaA__AAZ74485

SEQ ID NO: 183283 - RNA, 1701 nt, Artificial Sequence; identical to SEQ ID NO: 183280
  derived and/or modified sequence opt5 from hemagglutinin__InfluenzaA__AAZ74496

SEQ ID NO: 183284 - RNA, 1701 nt, Artificial Sequence; identical to SEQ ID NO: 183279
  derived and/or modified sequence opt5 from hemagglutinin__InfluenzaA__AAZ74507

SEQ ID NO: 183285 - RNA, 1701 nt, Artificial Sequence; identical to SEQ ID NO: 183280
  derived and/or modified sequence opt5 from hemagglutinin__InfluenzaA__AAZ74518

SEQ ID NO: 183286 - RNA, 1701 nt, Artificial Sequence; identical to SEQ ID NO: 183279
  derived and/or modified sequence opt5 from hemagglutinin__InfluenzaA__AAZ74529

SEQ ID NO: 183287 - RNA, 1701 nt, Artificial Sequence
  derived and/or modified sequence opt5 from hemagglutinin__InfluenzaA__AAZ74551
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacacucgaucugaccgacucugagaugaauaaacuuuuugaaagaaccaagaagcagcugcgggagaacgcggaagauaugggaaauggcugcuucaagauuuaccacaaaugugacaacgccugcaucggguccaucagaaauggcacauaugaucaugacguuuaccgcgacgaggcucucaacaaucgguuucagauuaagggaguggagcugaaaagcggcuacaaggauuggauccuuuggauuucuuucgccaucuccugcuuucugcucugugucgcccugcugggguucauuaugugggcuugccagaaaggaaacaucagauguaauaucugcauuuga

SEQ ID NO: 183288 - RNA, 1701 nt, Artificial Sequence; identical to SEQ ID NO: 183210
  derived and/or modified sequence opt5 from hemagglutinin__InfluenzaA__AAZ74562

SEQ ID NO: 183289 - RNA, 1701 nt, Artificial Sequence
  derived and/or modified sequence opt5 from hemagglutinin__InfluenzaA__AAZ74573
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucaucgaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacgggcaaugaucagaucucucucuaugcgcaggccuccgggcgcauuacagugagcaccaagagaucccaacagacaguuaucccgaacauuggaucucggccccgcgugagagacaucccuagccggaucuccauuuacuggaccaucgucaaacccggcgauauucugcugaucaauagcaccgggaaccucauugcuccucgcggauacuuuaagaucagaucuggcaaguccagcaucaugcggucugacgcccccauuggcaaauguaauagcgagugcaucacaccgaacggguccauuccuaaugacaagcccuuccagaacgugaaucgcaucacguauggagcuuguccuagauacgugaaacagaacacccugaagcuggccacaggcaugcggaauguccccgaaaaacaaacccgcgggauuuuuggagcgaucgccggcuucaucgagaacgggugggaaggaaugguugauggcugguauggcuuuagacaccaaaauucugaggggauuggacaggcugccgaccuuaagagcacacaggcugccaucaaccagauuaauggcaaacucaaccggcugaucgggaagaccaacgagaaguuccaccagauugaaaaagaguucuccgaaguggagggaagaauccaggaucuugaaaaguacguggaggacacgaaaauugaucuguggagcuauaaugccgagcuccuggucgcucuggaaaaccaacauacaaucgaccucaccgauucugagaugaauaagcuguuugaacgcaccaaaaagcagcuucgggagaacgcggaagacaugggcaaugggugcuucaagaucuaccacaaaugugauaacgccugcauuggcuccaucagaaauggaacauaugaccaugauguguaccgcgacgaggcucugaacaaucgguuucagauuaagggcguugagcucaaaagcggguacaaggacuggauccuguggauuucuuucgccaucuccugcuuucuucuguguguggcccuccugggauucaucaugugggcuugccagaaaggcaacauuagauguaauaucugcauuuga

SEQ ID NO: 183290 - RNA, 1701 nt, Artificial Sequence
  derived and/or modified sequence opt5 from hemagglutinin__InfluenzaA__AAZ74584
augaagaccaucauugcccugagcuacauccucugccugguguucgcucagaaacuucccggcaacgacaauuccacagccacgcugugucucgggcaccaugcggucccuaacggaacccugguuaagacaauugcuaaugaucaaaucgaggugaccaacgccacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggcuuauuccaauuguuacccuuaugacgugcccgauuacgccucucugcgcagccuuguugcuuccagcgggacccuggaauuuaacaaugagucuuucaacuggacgggaguggcccaaaauggcaccuccagcgcgugcaaaagacggucuaacaaguccuuuuucagccgccucaauuggcugcaccagcuuaaguauaaauacccugcccagaacgucacaaugcccaauaacgagaaguuugacaaacuguauauuuggggcgugcaucacccuucuaccgauuccgaccagaucagccucuacgcucaagccuccgggagaguuacagugucuaccaagcggagccagcagacggucauuccgaacaucggaucccgccccugggugagaggcgugagcucucggauuuccaucuacuggacaauugucaaaccuggggauauccugcugaucaauagcaccggaaaccucauugcuccccgcggcuauuucaagaucagaucuggaaagagcuccauuaugcggucugacgccccuaucgggaaauguaauagcgaaugcauuacacccaacggcuccaucccgaaugacaagccuuuucagaacguuaaucgcaucaccuacggcgcgugucccagauaugugaaacaaaacacccugaaacuugccacagggaugcggaaugugccugagaaacagacgcgcggaauuuucggcgcuaucgccggguuuauugaaaacggaugggagggcauggucgaugggugguacggauucagacaccagaauagcgagggcaccggccaagcugccgaccugaagucuacacaggccgcuaucaaccagauuaaugggaaacucaaccggcugaucgaaaagaccaaugagaaguuucaucagaucgaaaaagaguucuccgaaguggagggacgcauucaagaucuugagaaguauguugaagacacaaaaaucgaucuguggagcuacaacgcggagcuccugguggcccuggaaaaccagcacaccauugaccucacggauucugagaugaauaagcuguucgaaagaacaaagaagcagcuucgggagaacgcugaggacaugggcaaugggugcuuuaagaucuaucauaaaugugauaacgccugcauuggauccaucagaaauggcaccuacgaccacgaugucuaccgcgacgaagcccugaacaaucgguuccagauuaaggggguggagcucaaaagcggcuauaaggacuggauccuguggaucuccuuugcuauuucuugcuuccuucuguguguugcccuccugggauuuaucaugugggcgugccaaaaaggcaacauuagauguaauaucugcauuuga

SEQ ID NO: 183291 - RNA, 1701 nt, Artificial Sequence; identical to SEQ ID NO: 183267
  derived and/or modified sequence opt5 from hemagglutinin__InfluenzaA__AAZ74595

SEQ ID NO: 183292 - RNA, 1701 nt, Artificial Sequence
  derived and/or modified sequence opt5 from hemagglutinin__InfluenzaA__AAZ74617
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucuaagaucuccauuuacuggacaaucguuaaaccuggcgauauccugcucauuaacagcaccgggaaucugaucgcuccccggggauauuucaagauucgcucuggcaagagcuccaucaugagaucuaacgccccuauugggaaauguaauagcgaaugcaucacccccaacggauccaucccgaaugacaagccuuuucagaacgugaaucggauuacauacggcgccuguccccgcuaugugaaacagaacacgcuuaagcuggcgaccggcaugagaaaugucccugagaaacagacacgggggaucuucggagccauugcuggcuuuaucgaaaacgggugggagggaaugguggacggcugguacggguuccgccaucaaaauagcgagggaaccggccaggccgcugaucucaagucuacacaggccgccauuaaccaaaucaauggcaaacugaacagacuuaucgaaaagaccaaugagaaguuucaccagauugaaaaagaguucuccgaaguugaggggcggauccaggaccuggagaaguauguggaagauacgaaaauugaccucuggagcuacaacgcugagcugcuggucgcgcucgaaaaccagcauacaaucgaucugaccgacucugagaugaauaagcuguucgaaagaacccgcaaacaacugcgggagaacgccgaggauaugggaaauggcugcuuuaagauuuaucacaagugugacaacgcuugcaucggguccauuagaaauggaacauacgaucacgacguguaccgcgaugaagcccucaacaaucgguuccagaucaaaggcguugagcuuaagagcggguauaaagacuggauccuuuggauuuccuuugccaucucuugcuuccugcucugugugguccugcugggcuuuauuaugugggcuugccagaagggaaacaucagauguaauauuugcaucuga

SEQ ID NO: 183293 - RNA, 1701 nt, Artificial Sequence; identical to SEQ ID NO: 183071
  derived and/or modified sequence opt5 from hemagglutinin__InfluenzaA__AAZ79505

SEQ ID NO: 183294 - RNA, 1701 nt, Artificial Sequence
  derived and/or modified sequence opt5 from hemagglutinin__InfluenzaA__AAZ79516
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugccucaagaucuaucauaaaugugauaacgcuugcauuggauccaucagaaauggcaccuacgaccacgaugucuaccgcgacgaagcccugaacaaucgguuucagauuaaggggguggagcuuaaaagcggcuauaaggacuggauccuguggaucuccuucgccauuucuugcuuucuccuguguguugugcugcucggauucaucaugugggcuugccagaaaggcaacauuagauguaauaucugcauuuga

SEQ ID NO: 183295 - RNA, 1701 nt, Artificial Sequence
  derived and/or modified sequence opt5 from hemagglutinin__InfluenzaA__AAZ79527
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaacgccaaaccagaggcauuuucggggcgaucgccggauuuauugagaauggcugggaagggaugguggauggaugguacggcuuccggcaccagaacuccgagggcacagggcaggcugccgaccucaagagcacccaagcugccaucaaucagaucaacggaaaacugaauagacugauuggcaagacgaacgagaaguuucaccagaucgaaaaagaguucucugaagucgaggggcgcauucaggaucuugaacgguauguggaggacacaaagaucgaucugugguccuacaaugccgagcuccugguugcucuggaaaaccaacauaccauugaccucaccgauagcgagaugaacaaacuguucgaaagaacaaagaaacagcuucgcgagaaugcggaagacaugggaaacggcugcuuuaagaucuaucacaagugugauaaugccugcauugggucuauccggaacggcaccuacgaccaugacguguacagagaugaggcucugaauaaccgcuuccagaucaaaggagucgagcucaaguccggcuauaaagacuggauucuguggaucagcuuugccauuuccugcuuccuucuguguguggcccuccugggguuuaucaugugggcuugccagaagggaaauauucgguguaacaucugcaucuga

SEQ ID NO: 183296 - RNA, 1698 nt, Artificial Sequence
  derived and/or modified sequence opt5 from hemagglutinin__InfluenzaA__AAZ79549
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcaaccagagaacccuguaccacacagaaaaugcuuaugucagcgugguguccucucauuacagccggcgcuucacccccgagauuacgaaaagaccuaagguccgggaucaggaagggcgcaucaacuauuacuggacacuucuggagcccggagacaccauuaucuuugaggccaauggcaaccucauugcgccuugguaugccuucgcucuguccagaggguuuggaagcggcaucaucacaucuaaugcccccauggaugaaugugacgcuaagugccagaccccgcaaggcgccauuaacuccagccuuccuuuccagaauguucaccccgugaccaucggggaguguccuaaauacgugcggucugcgaagcugcgcauggucacaggacucagaaacauucccagcauccagucccggggccuguuuggggccauugcuggauucaucgaaggcggguggacgggaaugguggauggcugguauggcuaccaucaccagaaugagcaagggucuggauacgccgcugaccagaaaagcacccagaacgccaucaauggcauuacaaacaagguuaauuccgugaucgaaaagaugaacacccaguuuacagccgucgggaaagaguucaauaaacuggagcgcagaauggaaaaccucaacaagaagguggaugacggauuccuggauauuuggaccuauaaugcugagcuucugguucuccuggaaaacgagcggacgcuugacuuucacgacagcaaugugaaaaaccuguacgaaaaggucaaaucucaacucaagaauaacgcgaaagagaucggcaaugggugcuucgaguuuuaucauaaguguaacaaugaaugcauggaguccgugaagaacggcacauacgauuaucccaaauacagcgaagagucuaagcugaaucgcgagaaaauugacggagucaagcuggauuccaugggcguguaucagauccucgccaucuacagcaccguugcuuccucucuggugcuucuggucagccucggggccauuuccuucuggaugugcucuaacggaagccugcaguguagaaucugcauuuga

SEQ ID NO: 183297 - RNA, 1701 nt, Artificial Sequence
  derived and/or modified sequence opt5 from hemagglutinin__InfluenzaA__AAZ79560
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugaaaagccuuguugccuccagcgggacgcuggaauuuaacaaugagucuuucaacuggaccggaguggcucaaaauggcacauccagcgccugcaagcgcagaucuaacaaguccuuuuucagccggcucaauuggcugcaccagcuuaaauauaaguacccugcgcugaacgucaccaugcccaauaacgagaaauuugacaagcucuauauuuggggcgugcaucacccuucuacagauuccgaccagaucagccuguacgcccaggcuuccgggcgcguuaccgugucuacgaaaagaagccaacagacagucauuccgaacaucggaucccggcccugggugcgcggcgugagcucuagaauuuccaucuacuggaccauugucaagccuggggauauccugcucaucaauagcacaggaaaccugauugcuccccggggcuauuucaagauccgcucugggaaaagcuccauuaugagaucuaaugccccuaucggaaaguguaacagcgaaugcauuacccccaauggcuccaucccgaacgacaaaccuuuucagaauguuaaccggaucaccuacggcgccuguccccgcuaugugaagcagaauacacuuaaacuggcgacggggaugagaaacgugccugagaagcaaacccggggaauuuucggcgccaucgcuggguuuauugaaaauggaugggagggcauggucgacgggugguacggauuccgccaccagaacagcgagggcacaggccaggccgcugaucucaaaucuacccaagccgccaucaaucagauuaacgggaagcugaauagacuuaucgaaaagacaaacgagaaauuucaucagaucgaaaaggaguucuccgaaguggagggacggauucaggaccuggagaaauauguugaagauaccaagaucgaccucuggagcuacaacgcugagcugcugguggcgcucgaaaaucaacacacgauugaucugacagacucugagaugaacaaacuuuucgaaagaaccaagaagcagcugcgcgagaaugccgaggauaugggcaacgggugcuuuaaaaucuaucauaagugugacaaugcuugcauuggauccauccggaacggcaccuacgaucacgacgucuacagagaugaagcccucaauaaccgcuuccagauuaaagggguggagcuuaagagcggcuauaaagacuggauccuguggaucuccuuugccauuucuugcuuccugcucuguguugugcugcugggauuuaucaugugggcuugccagaagggcaauauucgguguaacaucugcauuuga

SEQ ID NO: 183298 - RNA, 1701 nt, Artificial Sequence
  derived and/or modified sequence opt5 from hemagglutinin__InfluenzaA__AAZ79571
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccggugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucaaaauggcacauccagcgccugcaaacggcgcucuaacaaguccuuuuucagcagacucaauuggcugcaucagcuuaaguauaaauacccugcgcugaacgucaccaugcccaauaacgagaaguuugacaaacucuauauuuggggcgugcaccauccuucuacagauuccgaccagaucagccuguacgcccaggcuuccgggcggguuaccgugucuacgaagcgcagccaacagacagucauuccgaacaucggauccagacccugggugcggggcgugagcucucgcauuuccaucuacuggaccauugucaaaccuggggauauccugcucaucaauagcacaggaaaccugauugcccccagaggcuauuucaagauccggucuggaaagagcuccauuaugcgcucugacgcuccuaucgggaaauguaauagcgaaugcauuacccccaacggcuccaucccgaaugacaagccuuuucagaacguuaauagaaucaccuacggcgccuguccccgguaugugaaacagaacacacuuaagcuggcgacggggaugcgcaaugugccugagaaacaaaccagaggaauuuucggcgccaucgcuggguuuauugaaaacggaugggagggcauggucgaugggugguacggauuccggcaccagaauagcgagggcacaggccaggccgcugaccucaagucuacccaagccgccaucaaccagauuaaugggaaacugaacagacuuaucgaaaagacaaaugagaaguuucaccagaucgaaaaagaguucuccgaaguggagggacgcauucaggaucuggagaaguauguugaagacaccaaaaucgaucucuggagcuacaacgcugagcugcugguggcgcucgaaaaccaacauacgauugaccugacagauucugagaugaauaaacuuuucgaacggaccaagaagcagcugagagagaacgccgaggacaugggcaaugggugcuuuaagaucuaucacaaaugugauaacgcuugcauuggauccauccgcaauggcaccuacgaccaugaugucuaccgggacgaagcccucaacaauagauuccagauuaaggggguggagcugaaaagcggcuauaaggacuggauccuuuggaucuccuuugccauuucuugcuuccugcucuguguugugcugcugggauuuaucaugugggcuugccagaaaggcaacauucgcuguaauaucugcauuuga

SEQ ID NO: 183299 - RNA, 1701 nt, Artificial Sequence
  derived and/or modified sequence opt5 from hemagglutinin__InfluenzaA__AAZ79582
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggauccggccccugggugcgcggggugagcucuagaauuuccaucuacuggaccauugucaaaccuggagauauccugcucaucaauagcacaggcaaccugauugcuccccggggguauuucaagauccgcucuggaaagagcuccauuaugagaucugacgccccuaucggcaaauguaauagcgaaugcauuacccccaacggcuccaucccgaaugacaagccuuuucagaacguuaaucggaucaccuacggggccuguccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccagaauagcgagggcacagggcaggccgcugaccucaagucuacccaagccgccaucaaccagauuaauggaaaacugaacagacuuaucgaaaagacaaaugagaaguuucaucagaucgaaaaagaguucuccgaaguggagggccggauucaggaucuggagaaguauguugaagacaccaaaaucgaucucuggagcuacaacgcugagcugcugguggcgcucgaaaaccaacacacgauugaccugacagauucugagaugaauaaacuuuucgaaagaaccaagaagcagcugcgcgagaacgccgaggacauggggaauggaugcuuuaagaucuaucauaaaugugauaacgcuugcauuggcuccauccggaaugggaccuacgaccacgaugucuacagagacgaagcccucaacaaucgcuuccagauuaagggcguggagcugaaaagcggauauaaggacuggauccuuuggaucuccuuugccauuucuugcuuccugcucuguguugugcugcugggcuuuaucaugugggcuugccagaaagggaacauucgguguaauaucugcauuuga

SEQ ID NO: 183300 - RNA, 1698 nt, Artificial Sequence
  derived and/or modified sequence opt5 from hemagglutinin__InfluenzaA__AAZ79604
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucugccaaacugcgcaugguuaccggccucagaaauauucccagcauccagucccgggggcuguuuggagcuauugccggcuucaucgaagggggauggacaggcaugguggacggcugguauggguaccaucaccagaacgaacaaggaucuggcuacgcugccgaucaaaagagcacgcagaaugccauuaaccgcaucaccaauaaagucaacuccgugaucgagaagaugaauacacaguuuaccgcuguugggaaagaguucaacaagcuggagagacggauggagaaucucaacaaaaagguggacgauggauuccuggacauuuggacauauaacgcggaacuucugguccuccuggagaaugaacgcacccuugacuuucacgauagcaacgugaagaaucuguacgagaaagucaagucucagcucaaaaacaaugccaaggaaaucggcaacgggugcuucgaguuuuaucauaaauguaauaacgagugcauggaauccgugaagaauggcacguacgacuaucccaaguacagcgaggaaucuaaacugaacagagagaagauugauggaguuaaacuggaguccaugggcguguaucagauccucgcuauuuacagcacagucgccuccucucuggugcuucugguuagccucggggccaucuccuucuggaugugcucuaauggaagccugcagugucggaucugcauuuga

SEQ ID NO: 183301 - RNA, 1701 nt, Artificial Sequence
  derived and/or modified sequence opt5 from hemagglutinin__InfluenzaA__AAZ79615
augaagaccaucauugcccugagcuacauccucugccugguguucgcucagaaaauucccggcaacgacaauuccacagccacgcuuugugucgggcaccaugcgguuccuaacggaaccaucgugaagacaauuaccaaugaucaaaucgaggugacaaacgcuaccgaacugguccagucuagcuccacaggcgggaucugcgacucuccgcaccagauucucgauggagagaauuguacccugaucgacgcccuucugggcgauccccagugcgacggguuucaaaacaaaaagugggaucucuucguggaaagaagcaaagccuauuccaauuguuacccuuaugacguucccgauuacgcuucucugcggagccugguggccuccagcggaacgcucgaguuuaacaaugaaucuuucaacuggaccggcgucacacagaauggcaccuccagcgcuugcaagcgcagaucuaacaauuccuuuuucagccggcugaacuggcuuacacaucugaaguuuaaauauccugcccucaaugugaccaugcccaacaacgagaaguucgacaaacuguacauuuggggaguucaccauccugggacggauaaugaccagaucucucuuuaugcgcaggccuccggccgcauuacagugagcaccaagagaucccaacagacagucaucccgaacauugggucucggccccgcgugagagauaucccuagccggaucuccauuuacuggaccaucgugaaacccggagacauucugcucaucaauagcaccggcaaccugauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgucaaucgcaucacguauggggcuuguccuagauacguuaaacagaacacccugaagcucgccacaggaaugcggaaugugcccgaaaaacaaacccgcggcauuuuuggggcgaucgccggauucaucgagaacggcugggaagggaugguggacggaugguauggcuuuagacaccagaauagcgagggcauugggcaggcugccgaucugaagucuacacaagcugccaucaaccagauuaauggaaaacuuaaccggcugaucggcaagaccaacgagaaguuccaccagauugaaaaagaguucuccgaagucgaggggagaauccaggaccucgaaaaguacguggaggauacgaaaauugaccuguggagcuauaaugccgagcuucugguugcucucgaaaaccaacauacaaucgaucugaccgacucugagaugaauaagcuguuugaacgcaccaaaaagcagcuccgggagaacgcggaagauaugggaaauggcugcuucaagaucuaccacaaaugugacaacgccugcauuggguccaucagaaauggcacauaugaucaugacguguaccgcgacgaggcucugaacaaucgguuucagauuaagggagucgagcuuaaaagcggcuacaaggauuggauccuguggauuucuuucgccaucuccugcuuucuccugugugugguucuucugggguucaucaugugggccugccagaaaggaaacauuagauguaauaucugcauuuga

SEQ ID NO: 183302 - RNA, 1701 nt, Artificial Sequence
  derived and/or modified sequence opt5 from hemagglutinin__InfluenzaA__AAZ79627
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacuccagcuuuuucucucggcugaauuggcucacacaucugaaguuuaaauauccugcccuuaaggucaccaugcccaacaaugagaaauucgacaagcuguacaucuggggagugcaccauccugggacggauaacgaccagauuucccucuaugcgcaggccagcggccgcaucacaguuuccaccaaaagaucucaacagacagugauuccgaacaucgggagccggccccgcgucagagauauuccuucccggaucagcaucuacuggaccauugugaagcccggagacauccugcugauuaauucuaccggcaaccucaucgcuccucgcggguacuuuaagauuagauccggaaaaagcucuaucaugcggagcgacgcccccaucggcaaguguaauuccgagugcauuacaccgaacggcucuaucccuaaugauaaacccuuccagaacgugaaucgcauuacguauggggcuuguccuagauacgucaagcagaacacccugaaacuugccacaggaaugcggaauguucccgaaaagcaaacccgcggcaucuuuggggcgauugccggauucaucgagaacggcugggaagggaugguggacggaugguauggcuuuagacaccagaauagcgagggcaucgggcaggcugccgaucugaaauccacacaagcugccauuaaccagaucaauggaaagcucaaccggcugauuggcaagaccaaugagaaauuccaccagaucgaaaaggaguucagcgaaguggaggggcgcauucaggaccuugaaaaauacgucgaggauacgaagaucgaccuguggucuuauaacgccgagcuccugguggcucuggaaaaccaacauacaauugaucucaccgacuccgagaugaauaaacuguuugaaagaaccaagaagcagcuucgggagaacgcggaagauaugggaaauggcugcuucaaaaucuaccacaagugugacaacgccugcaucgggagcauuagaaauggcacauaugaucaugacguuuaccgcgacgaggcucugaacaaucgguuucagaucaaaggaguggagcucaagucuggcuacaaagauuggauucuguggaucuccuucgccauuagcugcuuucuucugugugucgcccuccugggguucaucaugugggcuugccagaagggaaacaucagauguaauauuugcaucuga

SEQ ID NO: 183303 - RNA, 1701 nt, Artificial Sequence; identical to SEQ ID NO: 183280
  derived and/or modified sequence opt5 from hemagglutinin__InfluenzaA__AAZ79941

SEQ ID NO: 183304 - RNA, 1701 nt, Artificial Sequence; identical to SEQ ID NO: 183279
  derived and/or modified sequence opt5 from hemagglutinin__InfluenzaA__AAZ79944

SEQ ID NO: 183305 - RNA, 1701 nt, Artificial Sequence
  derived and/or modified sequence opt5 from hemagglutinin__InfluenzaA__AAZ79963
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgucuaucgggagccggccccgcauuagagaugucccuucccggaucagcaucuacuggaccauugugaaacccggagacauccugcugauuaacucuaccggcaaucucaucgcuccucgcggguacuuuaagauuagauccggaaagagcucuaucaugcggagcgacgcccccaucggcaaauguaacuccgagugcauuacaccgaauggcucuaucccuaacgauaagcccuuccagaaugugaaccgcauuacguauggggcuuguccuagauacgucaaacagaauacccugaaacuugccacaggaaugcggaacguucccgaaaaacaaacccgcggcaucuuuggggcgauugccggauucaucgagaauggcugggaagggaugguggacggaugguauggcuuuagacaccagaacagcgagggcacagggcaggcugccgaucugaaguccacccaagcugccaucaaucagauuaacggaaaacucaaucggcugaucggcaagacgaacgagaaguuccaccagauugaaaaagaguucagcgaaguggaggggagaauccaggaccuugaaaaguacgucgaggauacaaaaauugaccuguggucuuauaacgccgagcuccugguggcucuggaaaaucaacauaccaucgaucucaccgacuccgagaugaacaagcuguuugaacgcacaaagaagcagcuucgggagaaugcggaagauaugggaaacggcugcuucaagauuuaccacaaaugugacaaugccugcaucgggagcaucagaaacggcaccuaugaucaugacguuuaccgcgacgaggcucugaauaaccgguuucagauuaagggaguggagcucaaaucuggcuacaaggauuggauccuguggauuuccuucgccaucagcugcuuucuucugugugucgcccuccugggguucauuaugugggcuugccagaaaggaaauaucagauguaacaucugcauuuga

SEQ ID NO: 183306 - RNA, 1701 nt, Artificial Sequence
  derived and/or modified sequence opt5 from hemagglutinin__InfluenzaA__AAZ79974
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuucucucuaugcgcaggccuccggccgcaucacaguuagcaccaagagaucccaacagacagugauuccgaauaucgggucucggccccgcgucagagacauuccuagccggaucuccaucuacuggaccauugugaaacccggagauauccugcugauuaacagcaccggcaaucucaucgcuccucgcggguacuuuaagauuagaucuggaaaguccagcaucaugcggucugacgcccccaucggcaaauguaacagcgagugcauuacaccgaauggcuccaucccuaacgacaagcccuuccagaaugugaaccgcauuacguauggggcuuguccuagauacgucaaacagaauacccugaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacucaaccggcugauuggcaagaccaaugagaaguuccaccagaucgaaaaagaguucuccgaaguggaggggcgcauucaggaucuugaaaaguacgucgaggacacgaaaaucgaucuguggagcuauaacgccgagcuccugguggcucuggaaaaucaacauacaauugaccucaccgauucugagaugaacaagcuguuugaaagaaccaaaaagcagcuucgggagaaugcggaagacaugggaaacggcugcuucaagaucuaccacaaaugugauaaugccugcaucggguccauuagaaacggcacauaugaccaugauguuuaccgcgacgaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 183307 - RNA, 1701 nt, Artificial Sequence; identical to SEQ ID NO: 183279
  derived and/or modified sequence opt5 from hemagglutinin__InfluenzaA__AAZ79996

SEQ ID NO: 183308 - RNA, 1701 nt, Artificial Sequence
  derived and/or modified sequence opt5 from hemagglutinin__InfluenzaA__AAZ80007
augaagaccaucauugcccugagccacaucuucugccucgugcugggccaguaccuucccgggaacgacaauuccacagcuacgcugugucucggacaucacgccgucccuaacggcacccugguuaaaacaauuaccaaugaucaaaucgaggugacaaacgcgaccgaacuugugcagucuagcuccacagggaagauuugcaauaacccgcauagaauccuggacggaaucgauuguacccucauugacgcucugcugggcgauccccacugcgacggguuucagaaugagacgugggaucucuucgucgaacggucuaaagccuuuagcaacuguuauccuuacgacgugcccgauuaugccucccugcgcucucuuguugcuagcuccggaacccuggaguucaucacagaaggcuuuaccuggacaggcgugacccagaaugggggaagcaacgccugcaagagaggcccugggucuggauucuuuucccggcucaauuggcugacgaaaagcgagucuacauaccccguccuuaacgugaccaugccuaauaacgacaauuucgauaagcuguauauuuggggcguucaucacccguccacaaaccaagagcagaccagccucuacgugcaggcuucugggcgcgucaccguguccacaagacggagccagcaaacgaucauucccaacaucggaucccgcccuugggugagaggccugucuagccggauuuccaucuauuggaccaucgucaagcccggcgacguucuggugauuaauagcaacgggaaucucaucgccccucgcggauacuuuaaaaugagaacaggcaagucuuccauuaugcggagcgaugcgcccaucgacaccuguauuucugaaugcaucacaccgaacgggagcaucccuaaugacaaacccuuccagaacgugaauaagauuaccuacggagccuguccuaaauaugucaagcagaacacgcugaaacuugcuacaggcaugcgcaaugugcccgagaaacagaccagagggcuguuuggagccaucgcuggcuucauugaaaacggcugggaggggaugaucgauggaugguacggcuuucggcaccaaaauuccgaggggaccggacaggccgcggaccucaagucuacacaggccgcuauugaucaaaucaacggcaaacugaaucgcguuaucgaaaagaccaacgagaaauuccaucagauugaaaaggaguucagcgaaguggaggggagaauccaggaccuugagaaauaugucgaagauacaaagauugaccugugguccuacaaugccgagcuccugguggcucuggaaaaccagcacacgaucgaucucaccgacagcgagaugaacaagcuguuugaaaagacacggagacaacuucgcgagaaugccgaggauaugggcaacggaugcuucaagauuuaucauaaaugugacaaugccugcaucgaaucuauucggaacggcaccuacgaucacgacguuuauagagacgaggcucugaauaaccgcuuucagaucaaggggguggaacucaaauccggauacaaggauuggauccuguggauuagcuucgcgaucucuugcuuucuucugugugucgugcuccugggcuucauuaugugggccugccagcgggggaauaucagauguaacauuugcaucuga

SEQ ID NO: 183309 - RNA, 1701 nt, Artificial Sequence; identical to SEQ ID NO: 183280
  derived and/or modified sequence opt5 from hemagglutinin__InfluenzaA__AAZ80017

SEQ ID NO: 183310 - RNA, 1701 nt, Artificial Sequence
  derived and/or modified sequence opt5 from hemagglutinin__InfluenzaA__AAZ80030
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgggaucugcgacucuccgcaccagauccuugauggagaaaauuguacccugauugacgcccuccugggcgauccccagugcgacggguuucaaaacaagaaaugggaucuguucgucgagagaagcaaggccuauuccaauuguuacccuuaugacgugcccgauuacgcuucucuccggagccugguugccuccagcggaacgcuugaauuuaacaaugagucuuucaacuggaccggcgugacacagaauggcaccuccagcgcuugcaaacgcagaucuaacaauuccuuuuucagccggcugaacuggcucacacaucugaaguuuaaguauccugcccuuaaugucaccaugcccaacaacgagaaauucgacaagcuguacaucuggggagugcaccauccugggacggauaaugaccagacaucucucuaugcgcaggccuccggccgcauuaccguuagcacaaaaagaucccaacagaccgugaucccgaacauugggucucggccccgcgucagagauaucccuagccggauuuccaucuacuggaccaucgugaagcccggagacauucugcugaucaauagcacaggcaaccucauugcuccucgcggguacuuuaaaaucagaucuggaaaguccagcauuaugcggucugacgcccccaucggcaaguguaauagcgaaugcaucacgccgaacggcuccauuccuaaugauaaacccuuccagaacgugaaucgcaucaccuauggggcuuguccuagauacgucaagcagaacacacugaaacuugccaccggaaugcggaauguucccgagaagcaaacacgcggcauuuuuggggcgaucgccggauucauugaaaacggcugggaggggaugguggacggaugguauggcuuuagacaccaaaauucugagggcaucgggcaggcugccgaucugaaaagcacccaggcugccaucaaccagauuaauggaaagcucaaccggcugaucggcaaaacgaacgaaaaguuccaccagauugagaaggaguucuccgaaguggaagggagaauccaggaccuugagaaauacgucgaggauacaaagauugaccuguggagcuauaaugccgaacuccugguggcucuggagaaccaacauaccaucgaucucaccgacucugaaaugaauaaacuguuugagcgcacaaagaaacagcuucgggaaaacgcggaggauaugggaaauggcugcuucaagauuuaccacaagugugacaacgccugcaucggguccaucagaaauggcaccuaugaucaugacguuuaccgcgacgaggcucugaacaaucgguuucagauuaaaggaguggaacucaagagcggcuacaaagauuggauccuguggauuucuuucgccaucuccugcuuucuucugugugucgcccuccugggguucauuaugugggcuugccagaagggaaacaucagauguaauaucugcauuuga

SEQ ID NO: 183311 - RNA, 1701 nt, Artificial Sequence
  derived and/or modified sequence opt5 from hemagglutinin__InfluenzaA__AAZ83242
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaaauaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcaagcgcagaagcaauaagucuuucuucucccggcugaacuggcucacacaucugaaauauaaguacccugcccuuaaugucaccaugcccaacaacgagaaauuugacaagcuguauaucuggggcgugcaccauccugggacggauagcgaccagauuaaucucuacgcgcaggccucuggacgcaucacaguuuccaccaaaagaagccaacagacagugauuccgaacaucggcuaccggccccgcgucagagaugugccuucccggauuucuaucuauuggaccaucgugaagcccggggacauucugcugaucaauagcaccggaaaccucauugcuccucgcggcuacuucaagaucagauccgggaaaagcucuauuaugcgguccgacgcccccaucggaaaguguaauagcgaaugcaucacaccgaacggcucuauuccuaaugauaaacccuuucagaacgucaaucgcaucacguauggcgcuuguccuagauacguuaagcagaacacccugaaacuugccacagggaugcggaaugugcccgagaagcaaacccgcggaauuuucggcgcgaucgccggguuuauugaaaacggaugggagggcaugguggacgggugguauggauucagacaccagaauagcgagggcacaggccaggcugccgaucugaaauccacccaagcugccaucaaccagaucaaugggaagcucaaccggcugauuggaaagacgaacgaaaaauuucaccagaucgagaaggaauuuucugaggucgaaggccgcauucaggaccuugagaaauacguggaggauacaaagaucgaccuguggagcuauaaugccgaacuccugguugcucuggagaaccaacauaccauugaucucaccgacuccgaaaugaauaaacuguucgagagaacaaagaagcagcuucgggaaaacgcggaggauauggggaauggaugcuuuaaaaucuaccacaagugugacaacgccugcauuggcagcaucagaaaugggaccuacgaucaugacguguaucgcgacgaggcucugaacaaucgguuccagaucaaaggcgucgaacucaagucuggauacaaagauuggauucuguggaucuccuuugccauuagcugcuuccuucuguguguggcccuccugggcuuuaucaugugggcuugccagaaggggaacauuagauguaauaucugcaucuga

SEQ ID NO: 183312 - RNA, 1701 nt, Artificial Sequence
  derived and/or modified sequence opt5 from hemagglutinin__InfluenzaA__AAZ83266
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaaugaacuugugcagucuagcuccaccggcagaauuugcgacucuccgcaccagauccuggauggggagaacuguacacucaucgacgcccugcugggagauccccggugcgacggcuuucagaauaaagaaugggaucucuucgucgagcgcagcaaggccuauuccaacuguuacccuuaugacgugcccgauuacgcuucucugagaagccuuguugccuccagcgggacccuggaauuuaauaacgagucuuucaauuggacgggaguggcucaaaacggcaccuccagcgccugcaaacggcgcucuaauaaguccuuuuucagcagacucaacuggcugcaucagcuuaaguauaaauacccugcgcugaaugucacaaugcccaacaacgagaaguuugacaaacucuauauuuggggcgugcaccauccuucuaccgauuccgaccagaucagccuguacgcccaggcuuccgggcggguuacagugucuaccaagcgcagccaacagacggucauuccgaauaucggauccagacccugggugcggggcgugagcucucgcauuuccaucuacuggacaauugucaaaccuggggauauccugcucaucaacagcaccggaaaucugauugcccccagaggcuauuucaagauccggucuggaaagagcuccauuaugcgcucugacgcuccuaucgggaaauguaacagcgaaugcauuacacccaauggcuccaucccgaacgacaagccuuuucagaauguuaacagaaucaccuacggcgccuguccccgguaugugaaacagaauacccuuaagcuggcgacagggaugcgcaacgugccugagaaacaaacgagaggaauuuucggcgccaucgcuggguuuauugaaaauggaugggagggcauggucgaugggugguacggauuccggcaccagaacagcgagggcaccggccaggccgcugaccucaagucuacacaagccgccaucaaucagauuaacgggaaacugaauagacuuaucgaaaagaccaacgagaaguuucaccagaucgaaaaagaguucuccgaaguggagggacgcauucaggaucuggagaaguauguugaagacacaaaaaucgaucucuggagcuacaacgcugagcugcugguggcgcucgaaaaucaacauaccauugaccugacggauucugagaugaacaaacuuuucgaacggacaaagaagcagcugagagagaaugccgaggacaugggcaacgggugcuuuaagaucuaucacaaaugugauaaugcuugcauuggauccauccgcaacggcaccuacgaccaugaugucuaccgggacgaagcccucaauaacagauuccagauuaaggggguggagcugaaaagcggcuauaaggacuggauccuuuggaucuccuuugccauuucuugcuuccugcucuguguugugcugcugggauuuaucaugugggcuugccagaaaggcaauauucgcuguaacaucugcauuuga

SEQ ID NO: 183313 - RNA, 1701 nt, Artificial Sequence; identical to SEQ ID NO: 183210
  derived and/or modified sequence opt5 from hemagglutinin__InfluenzaA__AAZ83277

SEQ ID NO: 183314 - RNA, 1701 nt, Artificial Sequence; identical to SEQ ID NO: 183096
  derived and/or modified sequence opt5 from hemagglutinin__InfluenzaA__AAZ83288

SEQ ID NO: 183315 - RNA, 1701 nt, Artificial Sequence
  derived and/or modified sequence opt5 from hemagglutinin__InfluenzaA__AAZ83312
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuauuaaguccuuuuucagccgccucaacuggcugcaccagcuuaaguauaaauacccugcgcugaaugucaccaugcccaacaaugacaaguuugauaaacucuauaucuggggcgugcaucacccuucuacagacuccgaucagaccagccuguacgcccaggcuuccgggagaguuacggugucuacaaagcggagccaacagaccgucauuccgaacaucggaucccgccccugggugagaggcgugagcucucggauuuccaucuacuggacaauugucaaaccuggggacauccugcucaucaacagcaccggaaaucugauugcuccccgcggcuauuucaagaucagaucuggaaagagcuccauuauccggucugacgccccuauugggaaauguaacagcgagugcaucacccccaauggcuccaucccgaacgauaagccuuuucagaauguuaaccgcauuacauacggcgccugucccagauaugugaaacagaauacgcuuaagcuggcgaccgggaugcggaacgugccugaaaaacaaacacgcggaaucuucggcgccauugcuggguuuaucgagaauggaugggaaggcauggucgacgggugguacggauucagacaccagaacagcgagggcaccggccaggccgcugaucucaagucuacacaagccgccauuaaucagaucaacgggaaacugaaucggcuuaucgagaagaccaacgaaaaguuucaucagauugagaaagaguucuccgaaguggaaggaagaauccaggaccuggagaaguauguugaggauacgaaaauugaccucuggagcuacaaugcugaacugcugguggcgcucgagaaccaacacacaaucgaucugaccgacucugaaaugaacaagcuguucgagcgcacccggaaacagcugagagaaaaugccgaggauaugggcaacgggugcuuuaagauuuaucauaagugugacaaugcuugcaucggauccauucgcaacggcacauacgaucacgacgucuaccgggacgaggcccucaauaacagauuccagaucaaagggguggaacuuaagagcggcuauaaagauuggauccuuuggauuuccuuugccaucucuugcuuccugcucuguguugugcugcugggauuuauuaugugggcuugccagaagggcaauauccgcuguaacauuugcaucuga

SEQ ID NO: 183316 - RNA, 1701 nt, Artificial Sequence
  derived and/or modified sequence opt5 from hemagglutinin__InfluenzaA__AAZ83323
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcaggauuacgcuucucugagaagccuuguugccuccagcgggacgcuggaauuuaacaaugagucuuucaacuggaccggaguggcucaaaauggcacauccuaugccugcaaacggcgcagcauuaagucuuucuucuccagacucaacuggcugcaccagcuuaaguacaaauaucccgcgcugaaugucaccaugccuaacaaugacaaguuugauaaacucuacaucuggggcgugcaucaccccagcacagacucugaucagaccucccuguacgcccaggcuagcgggcggguuacgguguccacaaagcgcucucaacagaccgucauuagcaacaucggauccagaccuugggugcggggcgugagcucucgcauuuccaucuauuggacaauugucaaaccgggggacauccugcucaucaccagcaccggaaaccugauugcccccagaggcuacuucaagauccggucuggaaagagcuccauuaugcgcucugacgcuccuaucgggaaauguaauagcgagugcauuacacccaacggcuccaucccuaaugauaagcccuuucagaacguuaauagaaucacguauggcgccuguccgcgguacgugaaacagaacacccuuaagcuggcgacagggaugcgcaaugugccugaaaaacaaaccagaggaauuuucggcgccaucgcuggguuuauugagaacggaugggaaggcauggucgacgggugguauggauuccggcaccagaauagcgagggcacaggccaggccgcugaucucaagucuacccaagccgccaucaaccagauuaaugggaaacugaacagacuuaucgagaagacgaaugaaaaguuucaucagaucgagaaagaauuuuccgagguggaaggacgcauucaggaccuggagaaguacguugaggauacaaaaaucgaccucuggagcuauaacgcugaacugcugguggcgcucgagaaucaacacaccauugaucugaccgacucugaaaugaacaagcuguucgagcggacaagaaaacagcugcgcgaaaacgccgaggauaugggcaaugggugcuuuaagaucuaccauaagugugacaacgcuugcauuggauccauccggaauggcaccuacgaucacgacgucuauagagacgaggcccucaacaaucgcuuccagauuaaagggguggaacuuaagagcggcuacaaagauuggauccuuuggaucuccuuugccauuucuugcuuccugcucuguguugugcugcugggauuuaucaugugggcuugccagaagggcaacauucgguguaauaucugcauuuga

SEQ ID NO: 183317 - RNA, 1701 nt, Artificial Sequence; identical to SEQ ID NO: 183306
  derived and/or modified sequence opt5 from hemagglutinin__InfluenzaA__AAZ83371

SEQ ID NO: 183318 - RNA, 1701 nt, Artificial Sequence; identical to SEQ ID NO: 183279
  derived and/or modified sequence opt5 from hemagglutinin__InfluenzaA__AAZ83688

SEQ ID NO: 183319 - RNA, 1698 nt, Artificial Sequence
  derived and/or modified sequence opt5 from hemagglutinin__InfluenzaA__ABA06510
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauugccaaagaguccuggucuuacaucguugaaaccccgaaucccgagaacggcgccuguuauccuggguacuuugcugacuaugaggaacugagagagcaacucagcuccgugucuagcuucgaacgguuugagaucuuccccaaggaguccagcuggccuaaucauacggucaccggagugucugccuccugcagccacaacggcaagucuuccuuuuaccgcaaucugcuuuggcugacaggcaaaaacgggcucuaucccaaucugagcaagucuuacgcuaacaauaaagaaaaggagguucugauucucuggggagugcaucacccuccgaacaucggcgaucagagaacccuguaccacacagaaaacgccuaugucuccguggugagcucccauuacucucggcgcuucacccccgagauuacgaaaagaccuaagguccgggaccaggaagggcgcaucaauuauuacuggacacuucuggagcccggagauaccauuaucuuugaggcgaacggcaaucucauugccccuugguaugcuuucgcccugagcagaggguuuggauccggcaucaucacaagcaacgcucccauggacgaaugugaugccaagugccagaccccgcaaggcgcgauuaauucuucccuuccuuuccagaacguucaccccgugaccaucggggaguguccuaaauacgugcggagcgccaagcugcgcauggucacaggacucagaaauauucccucuauccagagccggggccuguuuggggcuauugccggauucaucgaaggcggguggacgggaaugguggacggcugguauggcuaccaucaccagaacgagcaaggguccggauacgcugccgaucagaaaucuacccagaaugccaucaacggcauuacaaauaagguuaacagcgugaucgaaaagaugaauacccaguuuacagcugucgggaaagaguucaacaaacuggagcgcagaauggaaaaucucaacaagaagguggacgauggauuccuggacauuuggaccuauaacgcggagcuucugguucuccuggaaaaugagcggacgcuugacuuucacgauuccaacgugaaaaaucuguacgaaaaggucaaaagccaacucaagaacaaugccaaagagaucggcaacgggugcuucgaguuuuaucauaaguguaauaacgaaugcauggagucugugaagaauggcacauacgacuaucccaaauacuccgaagagagcaagcugaaccgcgagaaaauugauggagucaagcuggacucuaugggcguguaucagauccucgcuaucuacuccaccguugccagcucccuggugcuucuggucucucucggggccauuagcuucuggaugugcuccaauggaucucugcaguguagaaucugcauuuga

SEQ ID NO: 183320 - RNA, 1698 nt, Artificial Sequence
  derived and/or modified sequence opt5 from hemagglutinin__InfluenzaA__ABA08464
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucugccaaacugcgcaugguuaccggccucagaaauauucccagcauccagucccgggggcuguuuggagcuauugccggcuucaucgaagggggauggacaggcaugguggacggcugguauggguaccaucaccagaacgaacaaggaucuggcuacgcugccgaucaaaagagcacgcagaaugccauuaacgggaucaccaauaaagucaacuccgugaucgagaagaugaauacacaguuuaccgcuguuggaaaagaguucaacaagcuggagcgcagaauggagaaucucaacaaaaagguggacgauggcuuccuggacauuuggacauauaacgcggaacuucugguccuccuggagaaugaacggacccuugacuuucacgauagcaacgugaagaaucuguacgagaaagucaagucucagcucaaaaacaaugccaaggaaaucgggaacggcugcuucgaguuuuaucauaaauguaauaacgagugcauggaauccgugaagaauggaacguacgacuaucccaaguacagcgaggaaucuaaacugaaccgcgagaagauugauggcguuaaacuggaguccauggggguguaucagauccucgcuauuuacagcacagucgccuccucucuggugcuucugguuagccucggagccaucuccuucuggaugugcucuaauggcagccugcaguguagaaucugcauuuga

SEQ ID NO: 183321 - RNA, 1698 nt, Artificial Sequence; identical to SEQ ID NO: 183320
  derived and/or modified sequence opt5 from hemagglutinin__InfluenzaA__ABA08486

SEQ ID NO: 183322 - RNA, 1698 nt, Artificial Sequence
  derived and/or modified sequence opt5 from hemagglutinin__InfluenzaA__ABA08508
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaaaagaaagaaguucugauucucuggggagugcaucacccuccgaacaucggcguccagagaacccuguacuauacagagaacgcuuacgugagcguggucuccucucacuauagccggcgcuucacccccgaaauuacgaagagaccuaagguucgggaucaggaggggcgcaucaauuacuauuggacacuucuggaacccggagacaccauuaucuuugaggccaacggcaaucucauugcgccuugguacgccuucgcucuguccagaggguuuggaagcggcaucaucacaucuaacgcccccauggaugagugugacgcuaaaugccagaccccgcaaggcgccauuaauuccagccuuccuuuccagaacgugcaucccgugaccaucggggaauguccuaaguauguccggucugcgaaacugcgcauggugacaggacucagaaauauucccagcauccagucccggggccuguuuggggccauugcuggauucaucgagggcggguggacgggaaugguugauggcugguacggcuaccaccaucagaacgaacaagggucuggauaugccgcugaccaaaagagcacccagaaugccaucaacggcauuacaaauaaagugaacuccgucaucgagaagaugaauacccaguuuacagccguggggaaagaguucaacaagcuggaacgcagaauggagaaucucaacaagaaaguugaugacggauuccuggauauuuggaccuacaacgcugaacuucuggugcuccuggagaaugaacggacgcuugacuuucacgacagcaacgucaagaaucuguaugagaaagugaagucucagcucaaaaacaaugcgaaggaaaucggcaacgggugcuucgaguuuuaccacaaguguaauaacgagugcauggaauccgucaaaaauggcacauaugauuaccccaaguauagcgaggaaucuaaacugaaccgcgagaagauugacggagugaaacuggauuccaugggcguuuaccagauccucgccaucuacagcaccguggcuuccucucugguccuucuggugagccucggggccauuuccuucuggaugugcucuaauggaagccugcaguguagaaucugcauuuga

SEQ ID NO: 183323 - RNA, 1698 nt, Artificial Sequence
  derived and/or modified sequence opt5 from hemagglutinin__InfluenzaA__ABA12707
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacuccgugaucgaaaagaugaauacacaguuuaccgcuguugggaaagaguucaacaaacuggagagacggauggaaaaucucaacaagaagguggacgauggauuccuggacauuuggacauauaacgcggagcuucugguccuccuggaaaaugagcgcacccuugacuuucacgauagcaacgugaaaaaucuguacgaaaaggucaaaucucaacucaagaacaaugccaaagagaucggcaacgggugcuucgaguuuuaucauaaguguaaugacgaaugcauggaguccgugaagaacggcacguacgauuaucccaaauacagcgaagagucuaagcugaauagagagaaaauugacggaguuaagcuggaauccaugggcguguaucagauccucgcuauuuacagcacagucgccuccucucuggugcuucugguuagccucggggccaucuccuucuggaugugcucuaacggaagccugcagugucggaucugcauuuga

SEQ ID NO: 183324 - RNA, 1698 nt, Artificial Sequence
  derived and/or modified sequence opt5 from hemagglutinin__InfluenzaA__ABA12715
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucuaccaaacugcgcaugguuacaggccucagaaauauucccagcauccagucccgggggcuguuuggagccauugcuggcuucaucgaagggggauggacgggcaugguggacggcugguauggguaccaucaccagaacgaacaaggaucuggcuacgccgcugaucaaaagagcacccagaaugccauuaacgggaucacaaauaaagucaacuccgugaucgagaagaugaauacccaguuuacagccguuggaaaagaguucaacaagcuggagcgcagaauggagaaucucaacaaaaagguggacgauggcuuccuggacauuuggaccuauaacgcugaacuucugguccuccuggagaaugaacggacgcuugacuuucacgauagcaacgugaagaaucuguacgagaaagucaagucucagcucaaaaacaaugcgaaggaaaucgggaacggcugcuucgaguuuuaucauaaaugugacaaugagugcauggaauccgugaagaacggaacauacgauuaucccaaguacagcgaggaaucuaaacugaaucgcgagaagauugacggcguuaaacuggaguccauggggguguaucagauccucgccauuuacagcaccgucgcuuccucucugguguuccuuguuagccugggagccaucuccuuuuggaugugcucuaacggcagccuccaguguagaaucugcauuuga

SEQ ID NO: 183325 - RNA, 1698 nt, Artificial Sequence
  derived and/or modified sequence opt5 from hemagglutinin__InfluenzaA__ABA12729
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuauauuagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauaugcuuucgcccugucccggggguuuggaagcggcauuaucaccucuaacgcucccauggacgaaugugaugccaagugccagacaccgcaaggcgcgaucaauuccagccuuccuuuccagaacgugcaccccgugaccauuggggaguguccuaaauacguccgcucugccaagcugagaauggugaccggacuccggaauauccccagcauucagucccgcggccuguuuggggcuaucgccggauucauugaaggcggguggacaggaaugguugacggcugguauggcuaccaucaccagaacgagcaagggucuggauacgcugccgaucagaaaagcacgcagaaugccaucaacggcaucaccaauaaggugaacuccgucauugaaaagaugaauacacaguuuaccgcuguggggaaagaguucaacaaacuggagagacggauggaaaaucucaacaagaagguugacgauggauuccuggacaucuggacauauaacgcggagcuucuggugcuccuggaaaaugagcgcacccuugacuuucacgauagcaacgucaaaaaucuguacgaaaaggugaaaucucaacucaagaacaaugccaaagagauuggcaacgggugcuucgaguuuuaucauaaguguaaugacgaaugcauggaguccgucaagaacggcacguacgauuaucccagauacagcgaagagucuaaacugaaucgggagaagaucgacggagugaaacuggaauccaugggcguuuaucagauucucgcuaucuacagcacaguggccuccucucugguccuucuggugagccucggggccaucuccuucuggaugugcucuaacggaagccugcaguguagaauuugcaucuga

SEQ ID NO: 183326 - RNA, 1701 nt, Artificial Sequence; identical to SEQ ID NO: 183310
  derived and/or modified sequence opt5 from hemagglutinin__InfluenzaA__ABA12740

SEQ ID NO: 183327 - RNA, 1701 nt, Artificial Sequence; identical to SEQ ID NO: 183279
  derived and/or modified sequence opt5 from hemagglutinin__InfluenzaA__ABA12751

SEQ ID NO: 183328 - RNA, 1701 nt, Artificial Sequence
  derived and/or modified sequence opt5 from hemagglutinin__InfluenzaA__ABA12762
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuccaaaacaaaaagugggaucuguuugucgaaagaagcaaagccuauuccaauuguuacccuuaugacgugcccgauuacgcuucucugcggagccucguugccuccagcggaacgcuggaguucaacaaugaaucuuuuaacuggaccggcgugacacagaauggcaccuccagcgcuugcaagcgcagaucuaacaauuccuucuuuagccggcuuaacuggcugacacaucucaaguucaaauauccugcccugaaugucaccaugcccaacaacgagaaguuugacaaacuuuacaucuggggagugcaccauccugggacggauaaugaccagauuucucuguaugcgcaggccuccggccgcaucacaguuagcaccaagagaucccaacagacagugauuccgaacaucgggucucggccccgcgucagagauauuccuagccggaucuccaucuacuggaccauugugaaacccggagacauccuccugauuaauagcaccggcaaccugaucgcuccucgcggguacuucaagauuagaucuggaaaguccagcaucaugcggucugacgcccccaucggcaaauguaauagcgagugcauuacaccgaacggcuccaucccuaaugauaagcccuuucagaacgugaaucgcauuacguauggggcuuguccuagauacgucaaacagaacacccucaagcuggccacaggaaugcggaauguucccgaaaaacaaacccgcggcaucuucggggcgauugccggauuuaucgagaacggcugggaagggaugguggacggaugguauggcuucagacaccaaaauucugagggcaucgggcaggcugccgaucuuaagagcacacaggcugccauuaaccagaucaauggaaaacugaaccggcucauuggcaagaccaacgagaaguuccaccagaucgaaaaagaguuuuccgaaguggaggggcgcauucaggaccuggaaaaguacgucgaggauacgaaaaucgaccuuuggagcuauaaugccgagcugcucguggcucuggaaaaccaacauacaauugaucugaccgacucugagaugaauaaacucuucgaaagaaccaagaagcagcugcgggagaacgcggaagauaugggaaauggcugcuuuaagaucuaccacaaaugugacaacgccugcaucggguccauuagaaauggcacauaugaucaugacguuuaccgcgacgaggcucuuaacaaucgguuccagaucaagggaguggagcugaaaagcggcuacaaggauuggauucucuggaucucuuuugccauuuccugcuuccugcuuugugucgugcugcucggguuuaucaugugggccugccagaaaggaaacaucagauguaauauuugcaucuga

SEQ ID NO: 183329 - RNA, 1701 nt, Artificial Sequence
  derived and/or modified sequence opt5 from hemagglutinin__InfluenzaA__ABA12773
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauucuggguuuuucucccggcugaacuggcucuacaaaagcggaucuaccuaucccguccugaaugugacgaugccuaacaaugacaacuuugauaaacuuuacauuuggggcguucaccauccguccacagaccaagagcagaccagccuguaugugcaggcuucugggcgcgucacaguguccaccaagagaagccagcaaaccaucauucccaacaucggaucccggccuugggugcgcggccucucuagcagaauuuccaucuacuggacaaucgucaagcccggcgacauucugguuaucaauagcaacgggaaucugauugccccucggggauacuucaagaugcgcacgggcaaaucuuccaucaugagaagcgaugcgcccauugggaccuguaucucugagugcaucacaccgaacggaagcauuccuaaugacaagcccuuucagaacgugaauaaaaucaccuauggcgccuguccuaaguacgugaagcagaacacacucaaacuggcuaccgggaugcggaauguccccgaaaagcagacgcgcggacuuuucggcgccauugcuggcuuuaucgagaacgggugggaaggaaugauugauggcugguauggguucagacaccaaaauuccgagggaacaggccaggccgcggaccugaaaucuacccaggccgcuaucgaucaaaucaacgggaagcucaaucgggugauugagaaaaccaacgaaaaguuccaccagaucgagaaagaauuuagcgagguugaaggccgcauucaggaccuggagaaguacguggaggauacaaagaucgaccuuugguccuauaaugccgaacugcucgucgcucuggagaaccagcauaccauugaucugacagacagcgaaaugaacaaacucuucgagaagacgagacggcaacugagagaaaaugccgaggauaugggaaacggcugcuuuaaaaucuaccacaagugugacaaugccugcauugggucuauccgcaacggaaccuaugaccaugauguguaccgggacgaggcucuuaauaacagauuccagaucaaaggcguugaacugaaguccggguacaaggauuggauucucuggaucagcuuugcgauuucuugcuuccugcuuugugugguccugcucggauuuaucaugugggccugccagaaaggcaauauucgcuguaacaucugcaucuga

SEQ ID NO: 183330 - RNA, 1701 nt, Artificial Sequence
  derived and/or modified sequence opt5 from hemagglutinin__InfluenzaA__ABA12780
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuucucucuaugcgcaggccuccggccgcaucacaguuagcaccaagagaucccaacagacagugauuccgaauaucgagucucggccccgcgucagagacauuccuagccggaucuccaucuacuggaccauugugaaacccggggauauccugcugauuaacagcaccggaaaucucaucgcuccucgcggcuacuuuaagauuagaucugggaaguccagcaucaugcggucugacgcccccaucggaaaauguaacagcgaaugcauuacaccgaauggcuccaucccuaacgacaagcccuuccagaaugugaaccgcauuacguauggcgcuuguccuagauacgucaaacagaauacccugaagcuggccacagggaugcggaacguucccgagaaacaaacccgcggaaucuuuggcgcgauugccggguucaucgaaaauggaugggagggcaugguggaugggugguauggauuuagacaccagaacucugagggcaucggccaggcugccgaccuuaagagcacacaagcugccauuaaucagaucaacgggaaacucaaccggcugauuggaaagaccaaugaaaaguuccaccagaucgagaaagaguucuccgaaguggaaggccgcauucaggaucuugagaaguacgucgaggacacgaaaaucgaucuguggagcuauaacgccgaacuccugguggcucuggagaaucaacauacaauugaccucaccgauucugaaaugaacaagcuguuugagagaaccaaaaagcagcuucgggaaaaugcggaggacauggggaacggaugcuucaagaucuaccacaaaugugauaaugccugcaucggcuccauuagaaacgggacauaugaccaugauguuuaccgcgacgaggcucugaauaaccgguuucagaucaagggcguggaacucaaaagcggauacaaggacuggauucuguggaucucuuucgccauuuccugcuuucuucugugugucgcccuccugggcuucaucaugugggcuugccagaaagggaauaucagauguaacauuugcaucuga

SEQ ID NO: 183331 - RNA, 1701 nt, Artificial Sequence
  derived and/or modified sequence opt5 from hemagglutinin__InfluenzaA__ABA16214
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacgagaagugggaucuguucgucgaacgcuccaaagccuuuucuaauuguuauccuuacgacgugcccgauuaugcuagccucagaucccugguugccagcucugggacgcuugaguucauuaacgaaggauuuaauuggaccggcgugacacaguccggcgggagcuacgcuugcaagcggggaucugucaaguccuucuuuagccgccugaacuggcucuaugagucugaguccaaauacccugcccugaaugugaccaugcccaacaauggcaaguucgacaaacuuuauaucuggggaguucaccauccuagcacagauaaggaacaaaccaaccuguacgugagagcguccgggcgggucacggugucuacaaaacgcagccagcagaccgugauuccgaauaucggccccagaccuuggguccgggggcucuccagccgcauuucuaucuacuggacaauuguuaagcccggagacauccugcugaucaacuccaccggcaaccucauugccccuagaggcuauuuuaagauccggaccgggaaaagcucuauuaugcgcagcgaugcucccaucggaacauguuccucuggcugcauuacgccgaaugggagcaucccuaacgacaagcccuuccagaaugugaacaaaaucaccuacggagccuguccuagauaugugaagcaaaauacacugaaacuugcuaccggcaugcggaacguccccgagaagcagacacgcgggauuuuuggagccaucgcgggcuucauugaaaauggcugggaggggaugguggacggaugguacggcuuuagacaccagaacuccgaggggaccggacaggccgcugaucugaaaagcacgcaagccgcuaucgaccagauuaauggcaagcucaaccggcugaucgaaaagacaaaugagaaauuccaccagaucgaaaaggaguucucugaaguugaggggcgcauucaagaucuugagaaauauguggaagacaccaagaucgaucugugguccuacaacgccgagcuccuggucgcccuggaaaaucagcauaccauugacaugacagauagcgagaugaacaaacucuuugaaaagaccagaaagcagcugcgggagaaugcugaggacaugggcaacggaugcuucaaaaucuaucacaagugugauaacgcgugcauuggcucuaucagaaaugggacauacgaccaugauguguaccgcgacgaagcccuuaacaaucgguuucagauuaaaggaguugagcugaaguccggcuauaaagacuggauccucuggaucagcuucgcuauuuccugcuuucugcuuugugugguccugcucggguucaucaugugggccugccaaaagggaaacauuagauguaauaucugcauuuga

SEQ ID NO: 183332 - RNA, 1701 nt, Artificial Sequence; identical to SEQ ID NO: 183280
  derived and/or modified sequence opt5 from hemagglutinin__InfluenzaA__ABA18026

SEQ ID NO: 183333 - RNA, 1698 nt, Artificial Sequence
  derived and/or modified sequence opt5 from hemagglutinin__InfluenzaA__ABA18037
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugaaggagcaacucuccucugugagcuccuucgaaagauuugagaucuuccccaagggaagcucuuggccuaaucauaccgucacaggcguguccgcuagcugcucucacaacggcaaauccagcuuuuaccggaaucugcuuuggcugaccgggaagaacggacucuaucccaaucugucuauguccuacguuaacaauaaagagaaggaagugcugguccucuggggcgugcaucacccuccgaacaucggggaucagcgcgcccuguaccacacagagaacgcuuaugugagcgucguuuccucucauuacagcagacgguucacccccgaaauugccaaacgcccuaaggugagagaccaggagggacggaucaauuauuacuggacgcuucuggaacccggcgauacaauuaucuuugaggcgaacgggaaucucauugccccuugguaugcuuucgcccugucccgcggauuuggcagcggcaucauuaccucuaacgcucccauggacgagugugaugccaagugccagacaccgcaaggggcgaucaauuccagccuuccuuuccagaacgugcaccccgucaccaucggagaauguccuaaauacgugagaucugccaagcugcggaugguuaccggccuccgcaauauucccagcauccaguccagagggcuguuuggagcuauugccggcuucaucgaagggggauggacaggcaugguggacggcugguauggguaccaucaccagaacgaacaaggaucuggcuacgcugccgaucagaaaagcacgcagaaugccauuaacgggaucaccaauaaggucaacuccgugaucgagaaaaugaauacacaguuuaccgcuguuggaaaggaguucaacaaacuggagcggcgcauggagaaucucaacaagaagguggacgauggcuuccuggacauuuggacauauaacgcggaacuucugguccuccuggagaaugaaagaacccuugacuuucacgauagcaacgugaaaaaucuguacgagaaggucaaaucucaacucaagaacaaugccaaagaaaucgggaacggcugcuucgaguuuuaucauaaguguaauaacgagugcauggaauccgugaagaauggaacguacgacuaucccaaauacagcgaggaaucuaagcugaaccgggagaaaauugauggcguuaagcuggaguccauggggguguaucagauccucgcuauuuacagcacagucgccuccucucuggugcuucugguuagccucggagccaucuccuucuggaugugcucuaauggcagccugcagugucgcaucugcauuuga

SEQ ID NO: 183334 - RNA, 1701 nt, Artificial Sequence; identical to SEQ ID NO: 183279
  derived and/or modified sequence opt5 from hemagglutinin__InfluenzaA__ABA18048

SEQ ID NO: 183335 - RNA, 1701 nt, Artificial Sequence
  derived and/or modified sequence opt5 from hemagglutinin__InfluenzaA__ABA18123
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaaguauaaauacccugcccugaacgugaccaugcccaauaacgagaaguuugacaaacucuauauuuggggcguucaucacccugggacagauucugaccagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgauauccugcucaucaauuccacagggaaccugauugcuccccggggauauuucaagauccgcagcggcaagucuagcauuaugagauccgacgccccuaucggcaaauguaauucugaaugcauuacccccaacgggagcaucccgaaugacaagccuuuucagaacgugaaucggaucaccuacggagcuuguccccgcuaugugaaacagaacacacuuaagcuggccacgggcaugagaaaugucccugagaaacaaacccgggggauuuucggagcgaucgccggcuuuauugaaaacgggugggagggaaugauggauggcugguacggcuuccgccaccaaaauuccgaggggacaggacaggcugccgaccucaagagcacccaggcugccaucaaccagauuaauggcaaacugaacagacuuaucgaaaagacaaaugagaaguuucaucagaucgaaaaagaguucucugaaguggaggggcggauucaggaucuggagaaguauguugaagacaccaaaaucgaucucugguccuacaacgccgagcugcugguggcucucgaaaaccaacacacgauugaccugacagauagcgagaugaauaaacuuuucgaaagaaccaagaagcagcugcgcgagaacgcggaggacaugggaaauggcugcuuuaagaucuaucauaaaugugauaacgccugcauugggucuauccggaauggcaccuacgaccacgaugucuacagagacgaagcucucaacaaucgcuuccagauuaagggaguggagcugaaauccggcuauaaggacuggauccuuuggaucagcuuugccauuuccugcuuccugcucuguaucguucugcugggguuuauuaugugggccugccagaaaggaaacauccgguguaauauuugcaucuga

SEQ ID NO: 183336 - RNA, 1701 nt, Artificial Sequence; identical to SEQ ID NO: 183279
  derived and/or modified sequence opt5 from hemagglutinin__InfluenzaA__ABA18134

SEQ ID NO: 183337 - RNA, 1698 nt, Artificial Sequence; identical to SEQ ID NO: 183323
  derived and/or modified sequence opt5 from hemagglutinin__InfluenzaA__ABA18145

SEQ ID NO: 183338 - RNA, 1701 nt, Artificial Sequence; identical to SEQ ID NO: 183280
  derived and/or modified sequence opt5 from hemagglutinin__InfluenzaA__ABA18156

SEQ ID NO: 183339 - RNA, 1701 nt, Artificial Sequence
  derived and/or modified sequence opt5 from hemagglutinin__InfluenzaA__ABA26700
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaacuccuuuuucagccggcugaauuggcucacacaucugaaguuuaaauauccugcccuuaacgucaccaugcccaacaaugagaaguucgauaaacuguacaucuggggagugcaccauccugggacggacaacgaucagauuucucucuaugcgcaggccccgggccgcaucacaguuuccaccaagagaagccaacagacagugauucccaauaucgggucccggccucgcgucagagacauucccucucggaucagcaucuacuggaccauugugaaaccuggagauauccugcugauuaacuccaccggcaaucucaucgcuccccgcggguacuuuaagauuagaagcggaaagucuuccaucaugcggagcgacgccccgaucggcaaauguaacucugagugcauuacaccuaauggcagcauccccaacgacaagccuuuccagaaugugaaccgcauuacguauggggcuugucccagauacgucaaacagaauacccugaaacuugccacaggaaugcggaacguucccgaaaagcaaacccgcggcaucuuuggggcgauugccggauucaucgagaauggcugggaagggaugguggauggaugguauggcuuuagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguucagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguuugaaagaaccaaaaagcagcuucgggagaaugcggaagacaugggaaacggcugcuucaagaucuaccacaaaugugauaaugccugcaucgggucuauuagaaacggcacauaugaccaugauguuuaccgcgacgaggcucugaauaaccgguuucagaucaagggaguggagcucaaauccggcuacaaggacuggauucuguggaucagcuucgccauuucuugcuuucuucugugugucgcccuccugggguucaucaugugggcuugccagaaaggaaauaucagauguaacauuugcaucuga

SEQ ID NO: 183340 - RNA, 1701 nt, Artificial Sequence
  derived and/or modified sequence opt5 from hemagglutinin__InfluenzaA__ABA26711
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaagagcgagugcauuacaccgaauggcuccaucccuaacgauaaacccuuccagaaugugaaccgcauuacguauggggcuuguccuagauacgucaagcagaauacccugaaacuugccacaggaaugcggaacguucccgaaaagcaaacccgcggcaucuuuggggcgauugccggauucaucgagaauggcugggaagggaugguggacggaugguauggcuuuagacaccagaacucugagggcaucgggcaggcugccgaucugaaaagcacacaagcugccauuaaucagaucaacggaaagcucaaucggcugauuggcaagaccaacgagaaauuccaccagaucgaaaaggaguucuccgaaguggaggggcgcauucaggaccuugaaaaauacgucgaggauacgaagaucgaccuguggagcuauaacgccgagcuccugguggcucuggaaaaucaacauacaauugaucucaccgacucugagaugaacaaacuguuugaaagaaccaagaagcagcuucgggagaaugcggaagauaugggaaacggcugcuucaaaaucuaccacaagugugacaaugccugcaucggguccauuagaaacggcacauaugaucaugacguuuaccgcgacgaggcucugaauaaccgguuucagaucaaaggaguggagcucaagagcggcuacaaagauuggauucuguggaucucuuucgccauuuccugcuuucuucugugugucgcccuccugggguucaucaugugggcuugccagaagggaaauaucagauguaacauuugcaucuga

SEQ ID NO: 183341 - RNA, 1701 nt, Artificial Sequence
  derived and/or modified sequence opt5 from hemagglutinin__InfluenzaA__ABA26722
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcccgacaggcgggaucugcgacagcccccaccagauccuugauggagagaauuguacccugauugacgcccuccugggcgauccucagugcgacggguuucaaaacaaaaagugggaucuguucgucgaaagaucuaaagcccauagcaauuguuaucccuacgacgugccugauuaugcuucccuccggucucugguugccagcuccggaacgcuugaguuuaacaaugaauccuucaacuggaccggcgugacacagaauggcaccucuuccgcuugcaagcgcagaagcaacaagucuuucuucucccggcugaauuggcucacacaccugaaauuuaaguaccccgcccuuaacgucaccaugccuaauaacgagaaauucgacaagcuguauaucuggggagugcaucacccggggacggauaacgaccagauuagccucuacgcgcaggccucuggccgcaucacaguuuccaccaaaagaagccaacagacagugauucccaauaucgggucccggccucgcgucagagaugugcccucucggauuagcaucuauuggaccaucgugaagccuggagacauucugcugaucaacuccaccggcaaucucauugcuccccgcggguacuuuaagaucagaagcggaaaaucuuccauuaugcggagcgacgccccgaucggcaaguguaacucuggcugcaucacaccuaaugggagcauucccaacgauaaaccuuuccagaaugucaaccgcaucacguacggagcuugucccagauauguuaagcagaauacccugaaacuugccacaggcaugcggaacgugcccgagaagcaaacccgcgggauuuuuggagcgaucgccggcuucauugaaaaugggugggagggaaugguggacggcugguacggcuuuagacaccagaacuccgaagggacaggacaggcugccgaucugaaaucuacccaagcugccaucaaucagaucaacggcaagcucaaucggcugauugggaagacgaacgagaaauuccaucagaucgagaaggaauuuagcgaggucgaaggacgcauucaggaccuugagaaauauguggaagauacaaagaucgaccugugguccuacaacgccgagcuccugguugcucuggagaaucaacacaccauugaucucaccgacagcgaaaugaacaaacuguuugagagaacaaagaagcagcuucgggaaaaugcggaggauaugggcaacgggugcuucaaaaucuaucauaagugugacaaugccugcauuggcucuaucagaaacggaaccuacgaucacgacguguaucgcgacgaagcucugaauaaccgguuucagaucaaaggcgucgagcucaaguccggguacaaagauuggauucuguggaucagcuucgccauuucuugcuuucuucuguguguggcccuccugggauucaucaugugggcuugccagaagggcaauauuagauguaacaucugcaucuga

SEQ ID NO: 183342 - RNA, 1701 nt, Artificial Sequence; identical to SEQ ID NO: 183267
  derived and/or modified sequence opt5 from hemagglutinin__InfluenzaA__ABA26733

SEQ ID NO: 183343 - RNA, 1701 nt, Artificial Sequence; identical to SEQ ID NO: 183267
  derived and/or modified sequence opt5 from hemagglutinin__InfluenzaA__ABA26755

SEQ ID NO: 183344 - RNA, 1701 nt, Artificial Sequence; identical to SEQ ID NO: 183306
  derived and/or modified sequence opt5 from hemagglutinin__InfluenzaA__ABA26766

SEQ ID NO: 183345 - RNA, 1701 nt, Artificial Sequence; identical to SEQ ID NO: 183306
  derived and/or modified sequence opt5 from hemagglutinin__InfluenzaA__ABA26788

SEQ ID NO: 183346 - RNA, 1701 nt, Artificial Sequence; identical to SEQ ID NO: 183306
  derived and/or modified sequence opt5 from hemagglutinin__InfluenzaA__ABA26799

SEQ ID NO: 183347 - RNA, 1698 nt, Artificial Sequence
  derived and/or modified sequence opt5 from hemagglutinin__InfluenzaA__ABA42247
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuacaaaaaucugcuuuggcugaccggcaagaacgggcucuaucccaaucugucuaaauccuacgcuaacaauaaggaaaaagaggugcugguccucuggggagugcaucacccuccgaacaucggcgaucagcgcgcccuguaccacacagaaaacgcuuaugugagcgucguuuccucucauuacagcagacgguucacccccgagauugccaagcgcccuaaggugagagaccaggaagggcggaucaauuauuacuggacgcuucuggagcccggagauacaauuaucuuugaggcgaacggcaaucucauugccccucgcuaugcuuucgcccuguccagaggguuuggaagcggcaucauuaccucuaacgcucccauggacgaaugugaugccaaaugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggguggacaggaaugguggacggcugguauggcuaccaucaccagaacgagcaagggucuggauacgcugccgaucaaaagagcacgcagaaugccauuaacggcaucaccaauaaagucaacuccgugaucgaaaagaugaauacacaguuuaccgcuguugggaaagaguucaacaagcuggagcgcagaauggaaaaucucaacaagaaaguggacgauggauuccuggacauuuggacauauaacgcggagcuucugguccuccuggaaaaugagcggacccuugacuuucacgauagcaacgugaagaaucuguacgaaaaagucaagucucagcucaaaaacaaugccaaggagaucggcaacgggugcuucgaguuuuaucauaaguguaaugacgaaugcauggaguccgugaaaaacggcacguacgauuaucccaaguacagcgaagagucuaaacugaaucgcgagaagauugacggaguuaaacuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 183348 - RNA, 1698 nt, Artificial Sequence; identical to SEQ ID NO: 183320
  derived and/or modified sequence opt5 from hemagglutinin__InfluenzaA__ABA42258

SEQ ID NO: 183349 - RNA, 1701 nt, Artificial Sequence; identical to SEQ ID NO: 183279
  derived and/or modified sequence opt5 from hemagglutinin__InfluenzaA__ABA42269

SEQ ID NO: 183350 - RNA, 1698 nt, Artificial Sequence
  derived and/or modified sequence opt5 from hemagglutinin__InfluenzaA__ABA42280
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcgaucagagaacccuguaccacacagaaaacgcuuaugucagcgugguguccucucauuacagccggcgcuucacccccgagauuacgaaaagaccuaagguccgggaccaggaagggcgcaucaauuauuacuggacacuucuggagcccggagauaccauuaucuuugaggccaacggcaaucucauugcgccuugguaugccuucgcucuguccagaggguuuggaagcggcaucaucacaucuaacgcccccauggacgaaugugaugcuaagugccagaccccgcaaggcgccauuaauuccagccuuccuuuccagaacguucaccccgugaccaucggggaguguccuaaauacgugcggucugcgaagcugcgcauggucacaggacucagaaauauucccagcauccagucccggggccuguuuggggccauugcuggauucaucgaaggcggguggacgggaaugguggacggcugguauggcuaccaucaccagaacgagcaagggucuggauacgccgcugaucagaaaagcacccagaaugccaucaacggcauuacaaauaagguuaacuccgugaucgaaaagaugaauacccaguuuacagccgucgggaaagaguucaacaaacuggagcgcagaauggaaaaucucaacaagaagguggacgauggauuccuggacauuuggaccuauaacgcugagcuucugguucuccuggaaaaugagcggacgcuugacuuucacgauagcaacgugaaaaaucuguacgaaaaggucaaaucucaacucaagaacaaugcgaaagagaucggcaacgggugcuucgaguuuuaucauaaguguaauaacgaaugcauggaguccgugaagaauggcacauacgacuaucccaaauacagcgaagagucuaagcugaaccgcgagaaaauugauggagucaagcuggacuccaugggcguguaucagauccucgccaucuacagcaccguugcuuccucucuggugcuucuggucagccucggggccauuuccuucuggaugugcucuaauggaagccugcaguguagaaucugcauuuga

SEQ ID NO: 183351 - RNA, 1701 nt, Artificial Sequence
  derived and/or modified sequence opt5 from hemagglutinin__InfluenzaA__ABA42291
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaagagcgagugcauuacaccgaauggcuccaucccuaacgauaaacccuuccagaaugugaaccgcauuacguauggggcuuguccuagauacgucaagcagaauacccugaaacuugccacaggaaugcggaacguucccgaaaagcaaacccgcggcaucuuuggggcgauugccggauucaucgagaauggcugggaagggaugguggacggaugguauggcuuuagacaccagaacucugagggcaucgggcaggcugccgaucugaaaagcacacaagcugccauuaaucagaucaacggaaagcucaaucggcugauuggcaagaccaacgagaaauuccaccagaucgaaaaggaguucuccgaaguggaggggcgcauucaggaccuugaaaaauacgucgaggauacgaagacagaccuguggagcuauaacgccgagcuccugguggcucuggaaaaucaacauaccaucgaucucaccgacucugagaugaacaaacuguuugaaagaacaaagaagcagcuucgggagaaugcggaagauaugggaaacggcugcuucaaaauuuaccacaagugugacaaugccugcaucggguccaucagaaacggcaccuaugaucaugacguuuaccgcgacgaggcucugaauaaccgguuucagauuaaaggaguggagcucaagagcggcuacaaagauuggauccuguggauuucuuucgccaucuccugcuuucuucugugugucgcccuccugggguucauuaugugggcuugccagaagggaaauaucagauguaacaucugcauuuga

SEQ ID NO: 183352 - RNA, 1701 nt, Artificial Sequence; identical to SEQ ID NO: 183075
  derived and/or modified sequence opt5 from hemagglutinin__InfluenzaA__ABA42302

SEQ ID NO: 183353 - RNA, 1701 nt, Artificial Sequence; identical to SEQ ID NO: 183129
  derived and/or modified sequence opt5 from hemagglutinin__InfluenzaA__ABA42313

SEQ ID NO: 183354 - RNA, 1701 nt, Artificial Sequence; identical to SEQ ID NO: 183075
  derived and/or modified sequence opt5 from hemagglutinin__InfluenzaA__ABA42346

SEQ ID NO: 183355 - RNA, 1701 nt, Artificial Sequence; identical to SEQ ID NO: 183129
  derived and/or modified sequence opt5 from hemagglutinin__InfluenzaA__ABA42357

SEQ ID NO: 183356 - RNA, 1701 nt, Artificial Sequence
  derived and/or modified sequence opt5 from hemagglutinin__InfluenzaA__ABA42379
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagcaaaauuucuaucuacuggaccauuguuaagccuggagacauccugcucaucaacuccacaggcaaucugauugcuccccggggguauuucaagauccgcagcggaaaaucuagcauuaugagauccgacgccccuaucggcaaguguaacucugaaugcauuacccccaauggcagcaucccgaacgauaaaccuuuucagaaugugaaccggaucaccuacgggcccuguccucgcuaugugaagcagaauacacuuaaacuggcuacgggaaugagaaacguccccgagaagcaaacccggggcauuuucggggccaucgcgggauuuauugaaaauggcugggaggggaugauggacggaugguacggcuuccgccaccagaacuccgagggcacagggcaggccgcugaucucaaaagcacccaagccgcuaucaaucagauuaacggaaagcugaauagacuuaucgaaaagacaaacgagaaauuucaucagaucgaaaaggaguucucugaaguggagggccggauucaggaccuggagaaauauguugaagauaccaagaucgaccucugguccuacaaugccgagcugcugguggcccucgaaaaccaacacacgauugaucugacagacagcgagaugaacaaacuuuucgaaagaaccaagaagcagcugcgcgagaaugcugaggauauggggaacggaugcuuuaaaaucuaucauaagugugacaaugcgugcauuggcucuauccggaacgggaccuacgaucacgacgucuacagagacgaagcccucaauaaccgcuuccagauuaaaggcguggagcugaaguccggauauaaagauuggauccuuuggaucagcuuugcuauuuccugcuucguucuguguaucgugcuccugggcuuuauuaugugggccugccagaaggggaauauccgguguaacauuugcaucuga

SEQ ID NO: 183357 - RNA, 1701 nt, Artificial Sequence; identical to SEQ ID NO: 183104
  derived and/or modified sequence opt5 from hemagglutinin__InfluenzaA__ABA42390

SEQ ID NO: 183358 - RNA, 1701 nt, Artificial Sequence
  derived and/or modified sequence opt5 from hemagglutinin__InfluenzaA__ABA42401
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaguccucugggagagugaccgucagcacgaagcggucccaacagacagugauuccgaacaucggaagcggccccugggugcgcggggucucuuccagaauuagcaucuacuggaccauuguuaaaccuggagacauccugcucaucaacucuacaggcaaucugauugcuccccggggguauuucaagauccgcagcggaaaguccucuauuaugagaagcgacgccccuaucggcaaauguaacuccaagugcauuacccccaauggcagcaucccgaacgauaaaccuuuucagaaugugaaccggaucaccuacggggccuguccccgcuaugugaagcagaauacacuuaaacuggcuacgggaaugagaaacgucccugaaaagcaaacccggggcauuuucggggccaucgcgggauuuauugagaauggcugggaagggaugauggacggaugguacggcuuccgccaccagaacucugagggcacagggcaggccgcugaucucaaauccacccaagccgcuaucaaucagauuaacggaaagcugaauagacuuaucgagaagacaaacgaaaaauuucaucagaucgagaaggaguucagcgaaguggaaggccggauucaggaccuggagaaauauguugaggauaccaagaucgaccucuggucuuacaaugccgaacugcugguggcccucgagaaccaacacacgauugaucugacagacuccgaaaugaacaaacuuuucgagagaaccaagaagcagcugcgcgaaaaugcugaggauauggggaacggaugcuuuaaaaucuaucauaagugugacaaugcgugcauuggcagcauccggaacgggaccuacgaucacgacgucuacagagacgaggcccucaauaaccgcuuccagauuaaaggcguggaacugaaguccggauauaaagauuggauccuuuggaucucuuuugcuauuagcugcuuccugcucuguaucguucugcugggcuuuauuaugugggccugccagaaggggaauauccgguguaacauuugcaucuga

SEQ ID NO: 183359 - RNA, 1701 nt, Artificial Sequence
  derived and/or modified sequence opt5 from hemagglutinin__InfluenzaA__ABA42412
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagcaaaauuucuaucuacuggaccauuguuaagccuggagacauccugcucaucaacuccacaggcaaucugauugcuccccggggguauuucaagauccgcagcggaaaaucuagcauuaugagauccgacgccccuaucggcaaguguaacucugaaugcauuacccccagcggcuccaucccgaaugauaaaccuuuucagaacgugaaucggaucaccuacgggcccuguccucgcuaugugaagcagaacacacuuaaacuggcuacgggaaugagaaauguccccgagaagcaaacccggggcauuuucggggccaucgcgggauuuauugaaaacggcugggaggggaugauggacggaugguacggcuuccgccaccagaauagcgagggcacagggcaggccgcugaucucaaaucuacccaagccgcuaucaaccagauuaauggaaagcugaacagacuuaucgaaaagacaaaugagaaauuucaucagaucgaaaaggaguucuccgaaguggagggccggauucaggaccuggagaaauauguugaagauaccaagaucgaccucuggagcuacaacgccgagcugcugguggcccucgaaaaucaacacacgauugaucugacagacucugagaugaacaaacuuuucgaaagaaccaagaagcagcugcgcgagaacgcugaggauauggggaauggaugcuuuaaaaucuaucauaagugugacaacgcgugcauuggcuccauccggaaugggaccuacgaucacgacgucuacagagacgaagcccucaacaaucgcuuccagauuaaaggcguggagcuuaagagcggauauaaagauuggauccuguggaucuccuuugcuauuucuugcuuccugcucuguaucguucugcugggcuuuauuaugugggccugccagaaggggaacauccgguguaauauuugcaucuga

SEQ ID NO: 183360 - RNA, 1701 nt, Artificial Sequence; identical to SEQ ID NO: 183071
  derived and/or modified sequence opt5 from hemagglutinin__InfluenzaA__ABA42443

SEQ ID NO: 183361 - RNA, 1701 nt, Artificial Sequence; identical to SEQ ID NO: 183075
  derived and/or modified sequence opt5 from hemagglutinin__InfluenzaA__ABA42454

SEQ ID NO: 183362 - RNA, 1701 nt, Artificial Sequence
  derived and/or modified sequence opt5 from hemagglutinin__InfluenzaA__ABA42465
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccuggggcagaggggugagcucucggauuuccaucuacuggaccauugucaaaccuggagacauccugcucaucaacagcacaggcaaucugauugcuccccgcggguauuucaagaucagaucuggaaagagcuccauuaugcggucugacgccccuaucggcaaauguaacagcgaaugcauuacccccaauggcuccaucccgaacgauaagccuuuucagaauguuaaccgcaucaccuacggggcuugucccagauaugugaaacagaauacacuuaagcuggccacgggaaugcggaacgugccugagaaacaaacccgcggcauuuucggggcgaucgccggauuuauugaaaauggcugggaggggaugauggacggaugguacggcuucagacaccagaacagcgagggcacagggcaggcugccgaucucaagucuacccaagcugccaucaaucagauuaacggaaaacugaaucggcuuaucgaaaagacaaacgagaaguuucaucagaucgaaaaagaguucuccgaagucgagggccgcauucaggaccuggagaaguauguggaagauaccaaaaucgaccucuggagcuacaaugccgagcugcugguugcucucgaaaaccaacacacgauugaucugacagacucugagaugaacaaacuuuucgaaagaaccaagaagcagcugcgggagaaugcggaggauauggggaacggaugcuuuaagaucuaucauaaaugugacaaugccugcauuggcuccaucagaaacgggaccuacgaucacgacguguaccgcgacgaagcucucaauaaccgguuccagauuaagggcgucgagcugaaaagcggauauaaggauuggauccuuuggaucuccuuugccauuucuugcuuccugcucuguaucgugcugcugggcuuuauuaugugggccugccagaaagggaauaucagauguaacauuugcaucuga

SEQ ID NO: 183363 - RNA, 1701 nt, Artificial Sequence
  derived and/or modified sequence opt5 from hemagglutinin__InfluenzaA__ABA42476
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgggagaaugcugaggauauggggaacggaugcuuuaagaucuaucauaaaugugacaaugcgugcauuggcucuaucagaaacgggaccuacgaucacgacgucuaccgcaaugaagcccucaacaaucgguuccagauuaagggcguggagcugaaauccggauauaaggacuggauccuuuggaucagcuuugcuauuuccugcuuccugcucuguaucguucugcugggcuuuauuaugugggccugccagaaagggaacaucagauguaauauuugcaucuga

SEQ ID NO: 183364 - RNA, 1701 nt, Artificial Sequence
  derived and/or modified sequence opt5 from hemagglutinin__InfluenzaA__ABA42498
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccugggugagaggcgucagcucuauuaucuccauuuacuggaccaucguuaaaccuggggacauccugcucauuaacagcacaggaaaucugaucgcuccccggggcuauuucaagauucgcucuggaaagagcuccaucaugagaucugacgccccuauugggaaauguaacagcgaaugcaucacccccaauggcuccaucccgaacgauaagccuuuucagaaugugaaccggauuaccuacggcgcuuguccccgcuaugugaaacagaauacacuuaagcuggccacggggaugagaaacgucccugagaaacaaacccggggaaucuucggcgcgauugccggguuuaucgaaaauggaugggagggcaugauggacgggugguacggauuccgccaccagaacagcgagggcacaggccaggcugccgaucucaagucuacccaagcugccauuaaucagaucaacgggaaacugaauagacuuaucgaaaagacaaacgagaaguuucaucagauugaaaaagaguucuccgaaguggagggacggauccaggaccuggagaaguauguugaagauaccaaaauugaccucuggagcuacaaugccgagcugcugguggcucucgaaaaccaacacacgaucgaucugacagacucugagaugaacaaacuuuucgaaagaaccaagaagcagcugcgcgagaaugcggaggauaugggcaacgggugcuuuaagauuuaucauaaaugugacaaugccugcaucggauccauucggaacggcaccuacgaucacgacgucuacagagacgaagcucucaauaaccgcuuccagaucaaggggguggagcugaaaagcggcuauaaggauuggauccuuuggauuuccuuugccaucucuugcuuccugcucuguauuguucugcugggauuuaucaugugggccugccagaaaggcaauauucgguguaacaucugcaucuga

SEQ ID NO: 183365 - RNA, 1701 nt, Artificial Sequence; identical to SEQ ID NO: 183096
  derived and/or modified sequence opt5 from hemagglutinin__InfluenzaA__ABA42509

SEQ ID NO: 183366 - RNA, 1701 nt, Artificial Sequence
  derived and/or modified sequence opt5 from hemagglutinin__InfluenzaA__ABA42520
augaagaccaucauugcccugagcuacauccucugccugguguucgcucagaaacuucccgucaacgacaauuccacagccacgcugugucucggccaccaugcgguuccuaacgggacccuggugaagacaauuaccaaugauuauaucgaggugacaaacgcuaccgaacuuguccaaucuagcuccacaggaagaauuugcgacucuccgcaccagauccuggauggcgagaauuguacccucaucgacgcccugcugggggauccccauugcgacggauuucagaacaaagaaugggaucucuucguggagcggagcacggccuacuccaauuguuauccuuacgacguucccgauuaugcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaccaacuuaaguacaaguauccugcgcugaaugugacaaugcccaacaaugagaaauuugacaagcucuacaucuggggcguucaucacccuucuaccgauuccgaccagauuagccuguacgcccaggcuuccggcagagugacggucucuacaaaacggagccagcaaaccgugaucccgaacauugggucccgccccugggugagaggagucagcucuaucauuuccaucuauuggacaaucguuaagccuggcgauauucugcucaucaacagcaccgggaaucugauugcuccccggggauacuucaaaauccgcucuggcaagagcuccauuaugagaucuaacgccccuaucgggaaguguaauagcgaaugcaucacccccaacggauccauuccgaaugacaaaccuuuucagaacgugaaucggaucacauauggcgccuguccccgcuacgugaagcagaacacgcuuaaacuggcgaccggcaugagaaaugucccugagaagcagacacgggggauuuucggagccaucgcuggcuuuauugaaaacgggugggagggaaugguggacggcugguauggguuccgccaccaaaauagcgagggaaccggccaggccgcugaucucaaaucuacacaggccgccaucaaccaaaucaauggcaagcugaacagacuuauugagaaaaccaaugaaaaguuucaucagaucgaaaaggaguucuccgaaguugaggggcggauucaggaccuggagaaauacguggaagauacgaagaucgaccucuggagcuauaacgcugagcugcuggucgcgcucgaaaaccagcacacaauugaucugaccgacucugagaugaauaaacuuuucgaaagaacccgcaagcaacugcgggagaacgccgaggauaugggaaauggcugcuuuaaaaucuaccauaagugugacaacgcuugcauuggguccaucagaaauggaacauacgaucacgacguguaucgcgaugaagcccucaacaaucgguuccagaucaagggcguugagcugaaaagcggguacaaggacuggauucuuuggaucuccuuugccauuucuugcuuccugcucugugugguccugcugggcuuuaucaugugggcuugccagaaaggaaacauuagauguaauaucugcaucuga

SEQ ID NO: 183367 - RNA, 1701 nt, Artificial Sequence
  derived and/or modified sequence opt5 from hemagglutinin__InfluenzaA__ABA42531
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuaccuguaugacguuccugauuacgcuucucuucgcagccugguggccuccagcggcacccucgaauuuaacaaugagucuuucaacuggacaggggucgcucagaauggaaccuccagcgccugcaagagacggucuauuaaauccuuuuucagccgccugaacuggcuucaucaacugaaguauaaguaccccgcgcucaaugugacaaugccuaacaaugagaaauuugacaagcuguauaucuggggcguucaccaccccucuaccgauuccgaccagauuagccuguacgcccaggcuuccggcagagugacggucucuacaaaacggagccagcaaaccgugaucccuaacauugggucccgcccgugggugagaggagucagcucucggaucuccauuuacuggacaaucguuaagcccggcgauauccuccugauuaacagcaccgggaaucuuaucgccccucgcggauauuucaaaauuagaucuggcaagagcuccaucaugcggucuaacgcucccauugggaaguguaauagcgaaugcaucaccccuaacggauccauccccaaugacaaaccguuucagaacgugaaucgcauuacauacggcgccuguccuagauaugugaagcagaacacgcugaaacucgcgaccggcaugcggaauguccccgagaagcagacacgcgggaucuucggagccauugcuggcuuuaucgaaaacgggugggagggaaugguggacggcugguacggguucagacaucaaaauagcgagggaaccggccaggccgcugaucugaaaucuacacaggccgccauuaaccaaaucaauggcaaacuuaaccggcugaucgaaaagaccaaugagaaguuucaccagauugaaaaggaguucuccgaaguugaggggagaauccaggaccucgagaaauauguggaagauacgaagauugaccuguggagcuacaacgcugagcugcucgucgcgcuggaaaaccagcauacaaucgaucuuaccgacucugagaugaauaaacuguucgaacgcacccggaagcaacucagagagaacgccgaggauaugggaaauggcugcuuuaaaauuuaucacaagugugacaacgcuugcaucggguccauucgcaauggaacauacgaucacgacguguaccgggaugaagcccugaacaauagauuccagaucaagggcguugagcuuaaaagcggguauaaggacuggauccuguggauuuccuuugccaucucuugcuuccuccugugugugguccugcucggcuuuauuaugugggcuugccagaaaggaaacauccgcuguaauauuugcaucuga

SEQ ID NO: 183368 - RNA, 1701 nt, Artificial Sequence; identical to SEQ ID NO: 183096
  derived and/or modified sequence opt5 from hemagglutinin__InfluenzaA__ABA42542

SEQ ID NO: 183369 - RNA, 1701 nt, Artificial Sequence
  derived and/or modified sequence opt5 from hemagglutinin__InfluenzaA__ABA42553
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggcccauuccaauuguuauccuuacgacguucccgauuaugcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaccaacuuaaguacaaguauccugcgcugaaugugacaaugcccaacaaugagaaauuugacaagcucuacaucuggggcguucaccauccuucuaccgauuccgaccagauuagccuguaugcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauacuucaaaauuagaucuggcaagagcuccaucaugcggucuaacgccccuauugggaaguguaauagcgaaugcaucacccccaacggauccaucccgaaugacaaaccuuuucagaacgugaaucgcauuacauauggcgccugucccagauacgugaagcagaacacgcuuaaacuggcgaccggcaugcggaaugucccugagaagcagacacgcgggaucuucggagccauugcuggcuuuaucgaaaacgggugggagggaaugguggacggcugguauggguucagacaccaaaauagcgagggaaccggccaggccgcugaucucaaaucuacacaggccgccauuaaccaaaucaauggcaagcugaaccggcuuaucgagaaaaccaaugaaaaguuucaucagauugaaaaggaguucuccgaaguugaggggagaauccaggaccuggagaaauacguggaagauacgaagauugaccucuggagcuauaacgcugagcugcuggucgcgcucgaaaaccagcacacaaucgaucugaccgacucugagaugaauaaacuuuucgaacgcacccggaagcaacugagagagaacgccgaggauaugggaaauggcugcuuuaaaauuuaccacaagugugacaacgcuugcaucggguccauucgcaauggaacauaugaucaugacguguaccgggaugaagcccucaacaauagauuccagaucaagggcguugagcugaaaagcggguacaaggacuggauccuuuggauuuccuuugccaucucuugcuuccugcucugugugguccugcugggcuuuauuaugugggcuugccagaaaggaaacauccgcuguaauauuugcaucuga

SEQ ID NO: 183370 - RNA, 1701 nt, Artificial Sequence; identical to SEQ ID NO: 183096
  derived and/or modified sequence opt5 from hemagglutinin__InfluenzaA__ABA42564

SEQ ID NO: 183371 - RNA, 1701 nt, Artificial Sequence
  derived and/or modified sequence opt5 from hemagglutinin__InfluenzaA__ABA42928
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucuaagaucuccauuuacuggacaaucguuaaaccuggcgauauccugcucauuaacagcaccgggaaucugaucgcuccccggggauauuucaagauucgcucuggcaagagcuccaucaugagaucuaacgccccuauugggaaauguaauagcgaaugcaucacccccaacggauccaucccgaaugacaagccuuuucagaacgugaaucggauuacauacggcgccuguccccgcuaugugaaacagaacacgcuuaagcuggcgaccggcaugagaaaugucccugagaaacagacacgggggaucuucggagccauugcuggcuuuaucgaaaacgggugggagggaauggugaauggcugguacggguuccgccaucaaaacagcgagggaaccggccaggccgcugaccucaagucuacacaggccgccauuaaucaaaucaacggcaaacugaauagacuuaucgaaaagaccaacgagaaguuucaccagauugaaaaagaguucuccgaaguugaggggcggauccaggaucuggagaaguauguggaagacacgaaaauugaucucuggagcuacaacgcugagcugcuggucgcgcucgaaaaucagcauacaaucgaccugaccgauucugagaugaacaagcuguucgaaagaacccgcaaacaacugcgggagaaugccgaggacaugggaaacggcugcuuuaagauuuaucacaagugugauaaugcuugcaucggguccauuagaaacggaacauacgaccacgauguguaccgcgacgaagcccucaauaaccgguuccagaucaaaggcguugagcuuaagagcggguauaaagauuggauccuuuggauuuccuuugccaucucuugcuuccugcucugugugguccugcugggcuuuauuaugugggcuugccagaagggaaauaucagauguaacauuugcaucuga

SEQ ID NO: 183372 - RNA, 1701 nt, Artificial Sequence; identical to SEQ ID NO: 183096
  derived and/or modified sequence opt5 from hemagglutinin__InfluenzaA__ABA42939

SEQ ID NO: 183373 - RNA, 1701 nt, Artificial Sequence
  derived and/or modified sequence opt5 from hemagglutinin__InfluenzaA__ABA42978
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaauccccaacaaugagaaauuugacaagcucuauauuuggggcguucaccacccuucuaccgauuccgaccagaucagccuguacgcccaggcuuccggcagagugacggucucuacaaaacggagccagcaaaccgugauuccgaacaucgggucccgccccugggugagaggagucagcucucggauuuccaucuacuggacaaucguuaagccuggcgauauucugcucaucaacagcaccgggaaucugauugcccccagaggauauuucaaaaucagaucuggcaagagcuccauuaugcggucuaacgcuccuaucgggaaguguaauagcgaaugcaucacccccaacggauccauuccgaaugacaaaccuuuucagaacgugaaucgcaucacauacggcgccugucccagauaugugaagcagaacacgcuuaaacuggcgaccggcaugcggaaugucccugagaagcagacacgcgggauuuucggagccaucgcuggcuuuauugaaaacgggugggagggaaugguggacggcugguacggguucagacaucaaaauagcgagggaaccggccaggccgcugaucucaaaucuacacaggccgccaucaaccaaaucaauggcaagcugaaccggcuuauugagaaaaccaaugaaaaguuucaccagaucgaaaaggaguucuccgaaguugaggggcgcauucaggaccuggagaaauauguggaagauacgaagaucgaccucuggagcuacaacgcugagcugcuggucgcgcucgaaaaccagcauacaauugaucugaccgacucugagaugaauaaacuuuucgaacgcacccggaagcaacugagagagaacgccgaggauaugggaaauggcugcuuuaaaaucuaucacaagugugacaacgcuugcauuggguccauccgcaauggaacauacgaucacgacguguaccgggaugaagcccucaacaauagauuccagaucaagggcguugagcugaaaagcggguauaaggacuggauucuuuggaucuccuuugccauuucuugcuuccugcucugugugguccugcugggcuuuaucaugugggcuugccagaaaggaaacauucgcuguaauaucugcaucuga

SEQ ID NO: 183374 - RNA, 1701 nt, Artificial Sequence; identical to SEQ ID NO: 183267
  derived and/or modified sequence opt5 from hemagglutinin__InfluenzaA__ABA43167

SEQ ID NO: 183375 - RNA, 1701 nt, Artificial Sequence
  derived and/or modified sequence opt5 from hemagglutinin__InfluenzaA__ABA43178
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacaauugaucucaccgacucugagaugaauaagcuguuugaaagaaccaaaaagcagcuucgggagaacgcggaagauaugggaaauggcugcuucaagaucuaccacaaaugugacaacgccugcaucggguccauuagaaauggcacauaugaucaugacguuuaccgcgacgaggcucugaacaaucgguuucagaucaagggaguggagcucaaaagcggcuacaaggauuggauucuguggaucucuuucgccauuuccugcuuucuucuguguaucgcccuccugggguucaucaugugggcuugccagaaaggaaacauuagauguaauaucugcauuuga

SEQ ID NO: 183376 - RNA, 1698 nt, Artificial Sequence
  derived and/or modified sequence opt5 from hemagglutinin__InfluenzaA__ABA43189
augaaggccaaacugcucgugcugcuuugcaccuucacagcuacguacgccgacaccaucugugucggcuaucacgcgaacaauagcacagauaccguugacacagugcuggagaagaacgugaccgucacacauuccgugaaucuccuggaagauucucacaacgggaaacuuugccugcucaagggaauugcuccccugcagcugggcaauuguagcguugccggguggauccucggaaacccugagugcgaacugcuuauuuccaaagagucuuggagcuacaucguggaaaccccgaaucccgagaacggcacguguuauccuggguacuuugccgacuaugaggaacugagagagcaacucuccucugucagcuccuucgaacgguuugagauuuuccccaagggaagcucuuggccuaaucauaccgugacaggcguuuccgcuagcugcucucacaacggcaaguccagcuuuuaccgcaaucugcuuuggcugaccgggaaaaacggacucuaucccaaucugucuauguccuacgugaacaauaaggagaaagaaguccuggugcucuggggcgugcaucacccuccgaacaucggggaucagagagcccuguaccacacagagaacgcuuaugucagcguuguguccucucauuacagccggcgcuucacccccgaaaucgccaagagaccuaaagugcgggaccaggagggacgcauuaauuauuacuggacgcuucuggaacccggcgauacaaucauuuuugaggcgaacgggaaucucaucgccccuugguaugcuuucgcccuguccagaggauuuggcagcggcauuaucaccucuaacgcucccauggacgagugugaugccaagugccagacaccgcaaggggcgauuaauuccagccuuccuuuccagaacguccaccccgugaccaucggagaauguccuaaguacguucggucugccaaacugcgcauggugaccggccucagaaauauccccagcauucagucccgggggcuguuuggagcuaucgccggcuucauugaagggggauggacaggcauggucgacggcugguauggguaccaucaccagaacgaacaaggaucuggcuacgcugccgaucaaaagagcacgcagaaugccaucaacgggauuaccaauaaagugaacuccguuaucgagaagaugaauacacaguuuaccgcugugggaaaagaguucaacaagcuggagcgcagaauggagaaucucaacaaaaaggucgacgauggcuuccuggacaucuggacauauaacgcggaacuucuggugcuccuggagaaugaacggacccuugacuuucacgauagcaacgucaagaaucuguacgagaaagugaagucucagcucaaaaacaaugccaaggaaauugggaacggcugcuucgaguuuuaucauaaauguaauaacgagugcauggaauccguuaagaauggaacguacgacuaucccaaguacagcgaggaaucuaaacugaaccgcgagaagaucgauggcgugaaacuggaguccaugggggucuaucagauucucgcuaucuacagcacaguggccuccucucugguucuucuggugagccucggagccauuuccuucuggaugugcucuaauggcagccugcaguguagaaucugcaucuga

SEQ ID NO: 183377 - RNA, 1701 nt, Artificial Sequence
  derived and/or modified sequence opt5 from hemagglutinin__InfluenzaA__ABA43200
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccuggugguucuggaaaaccaacauacaauugaucucaccgacucugagaugaauaagcuguuugaaagaaccaaaaagcagcuucgggagaacgcugaagauaugggaaauggcugcuucaagaucuaccacaaaugugacaacgcgugcaucggguccauuagaaauggcacauaugaucaugacguguaccgcgacgaggcccugaacaaucgguuucagaucaagggagucgagcucaaaagcggcuacaaggauuggauucuguggaucucuuucgcuauuuccugcuuucuucugugugugguucuccugggguucaucaugugggccugccagaaaggaaacaucagauguaauauuugcaucuga

SEQ ID NO: 183378 - RNA, 1701 nt, Artificial Sequence
  derived and/or modified sequence opt5 from hemagglutinin__InfluenzaA__ABA43336
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcaaaauucuagcacaggcagaauuugcgacuccccgcaccggauccuugaugggaaaaacuguacccugaucgacgcccuccugggagauccccauugcgacggcuuccagaauaaggagugggaucuguuugucgaacgcucuaaagccuauagcaacuguuacccuuaugacgugcccgauuacgcuucccucagaucucugguugccagcuccgggacgcuugaguucauuaaugaagacuuuaacuggaccggaguggcucagagcggcggcucuuaugccugcaagcggggguccgucaauagcuucuuuucucgccugaacuggcuccacgaguccgaguacaaguauccugcgcugaaugugacaaugcccaacaauggaaaauucgauaaacuuuacguuuggggcgugcaucacccuaucaccgacagagaacagacaaagcuguacguccgggccagcgggcgcgugaccgugucuacgaagagaucccagcagacagucauuccgaacaucggaagccggcccuggguucgcggccucuccucuagaauuagcaucuauuggaccauugugaaaccuggggauauccugcugaucaacuccacaggaaaucucauugcuccccggggcuacuuuaagauccgcaccggcaagagcucuauuaugagauccgacgccccuaucgggaccuguagcucugagugcauuacacccaacggaagcaucccgaaugacaaaccuuuccagaacgugaaucggaucacguauggcgcuuguccccgcuacgucaagcaaaacacccugaaacuugccacagggaugagaaaugugccugaaaagcagacccggggaauuuuuggcgcgaucgccggguucauugagaacggaugggagggcaugguugauggcugguauggguuuagacaccaaaauuccgaaggaacaggccaggcugccgaccugaaaucuacccaggcugccaucgaucagauuaacgggaagcucaaucgccugaucgagaaaacgaacgaaaaguuccaucagaucgagaaggaguucagcgaaguggagggacggauucaagaccuugaaaaauacgucgaggauacaaagaucgaccugugguccuauaaugccgaacuccugguggcucuggagaaccagcacaccauugaucucaccgacagcgaaaugaauaaacuguuugagaagacaagaaaacagcuucgcgagaacgcggaagauaugggcaacgggugcuucaagaucuaccauaagugugacaaugccugcauuggcucuauccggaacggaaccuacgaucacgacguuuauagagacgaggcucugaauaaccgcuuucagauuaaaggcguggaacucaaguccggguacaaagauuggauccuguggaucagcuucgccauuucuugcuuucuucugugugucgugcuccugggauucaucaugugggccugccaaaagggcaauauucgguguaacaucugcauuuga

SEQ ID NO: 183379 - RNA, 1707 nt, Artificial Sequence
  derived and/or modified sequence opt5 from hemagglutinin__InfluenzaA__ABA54915
auggagaaggugguccugcuccuggccaccgcuagccuuguuaaauccgaccagaucugcauuggcuaccacgccaacaauucuacagaacaaguggauacgaucauggagaagaacgugaccgucacacaugcgcaggacauucuggaaaagacccacaaugggaaacucugugaucuggacggagugaaaccccuuauccugagagauugcagcguugcuggcuggcuccuggggaacccuaugugugacgaguucauuaaugugccggaaugguccuauaucgucgagaaggccucucccgccaacgaucugugcuacccuggagacuuuaaugauuaugaggaacucaagcaucugcuuagccggaucaaccacuucgagaaaauucagaucauucccaaguccucuuggagcaaucaugaggcuuccagcggcgugucugccgcuuguccuuaccacgggaaacccuccuuuuuccgcaacguuguguggcugaucaagaaaaauagcgccuauccuacaauuaagagaucuuacaacaauaccaaccaggaagaccuccugguccuuuggggaauccaccauccgaaugaugcggccgagcaaacaaagcuguaucagaaccccaccacguacauuuccgugggcaccagcacacucaaccagcggcuggugccuaaaaucgcuacccgcucuaaggucaauggccaguccgggagaauggaauuuuucuggacaauccugaaacccaacgacgccauuaauuuugagagcaacggaaauuucaucgcuccugaauacgccuauaagauuguuaaaaagggcgauuccgcgaucaugaaaucugagcucgaauacgggaacugcaauaccaagugucaaacgcccaugggagccauuaacagcuccaugccguuucacaauauccauccucugacaaucggcgagugccccaaguaugugaaaagcaaccggcuugugcuggcuaccgggcuccgcaauacaccucagagagagcggcgcagaaagaaacggggacuguucggcgccauugcuggcuuuaucgaagggggauggcagggcauggucgacgggugguacggauaucaccacucuaacgagcagggcuccggguacgccgccgacaaggaaagcacccaaaaagcuauugauggagugaccaauaagguuaacucuaucauugacaagaugaauacacaguucgaggcggugggccgcgaauuuaacaaccuugagagacggaucgagaaucugaacaaaaagauggaagauggcuuccucgacgucuggacguauaaugccgagcugcuggugcucauggaaaacgagcgcacccuggauuuccaugacagcaauguuaaaaaccuuuacaauaaggugagacugcagcuccgggauaacgcuaaagaacuggggaauggauguuuugaguucuaccacaagugcgacaacgaguguauggaauccgucaagaauggcacauaugauuacccccaauauucugaggaagccagacuuaaccgcgaggagaucagcggggugaaacuggaauccaugggaaccuaccagauucucagcaucuauucuacagucgccuccagccuggcucuggccauuaugguggcgggccucucucuguggaugugcuccaaugggagccuucagugccggaucuguauuuga

SEQ ID NO: 183380 - RNA, 1698 nt, Artificial Sequence
  derived and/or modified sequence opt5 from hemagglutinin__InfluenzaA__ABA87080
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuaucgaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacaugggcgaucagagagcccuguaccacacagaaaacgcuuaugugagcguggucuccucucauuacagccggcgcuucacccccgagauugccaaaagaccuaagguucgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgugaccaucggggaguguccuaaauacguccgcucugccaagcugagaauggugaccggacuccggaauauucccagcauccagucccgcggccuguuuggggcuauugccggauucaucgaaggcggguggacaggaaugguugacggcugguauggcuaccaucaccagaacgagcaagggucuggauacgcugccgaucagaaaagcacgcagaaugccauuaacggcaucaccaauaaggugaacuccgucaucgaaaagaugaauacacaguuuaccgcuguggggaaagaguucaacaaacuggagagacggauggaaaaucucaacaagaagguugacgauggauuccuggacauuuggacauauaacgcggagcuucuggugcuccuggaaaaugagcgcacccuugacuuucacgauagcaacgucaaaaaucuguacgaaaaggugaaaucucaacucaagaacaaugccaaagagaucggcaacgggugcuucgaguuuuaucauaaguguaaugacgaaugcauggaguccgucaagaacggcacguacgauuaucccaaauacagcgaagagucuaagcugaauagagagaaaauugacggagugaagcuggaauccaugggcguuuaucagauccucgcuauuuacagcacaguggccuccucucugguccuucuggugagccucggggccaucuccuucuggaugugcucuaacggaagccugcagugucggaucugcauuuga

SEQ ID NO: 183381 - RNA, 1698 nt, Artificial Sequence; identical to SEQ ID NO: 183320
  derived and/or modified sequence opt5 from hemagglutinin__InfluenzaA__ABA87091

SEQ ID NO: 183382 - RNA, 1698 nt, Artificial Sequence; identical to SEQ ID NO: 183320
  derived and/or modified sequence opt5 from hemagglutinin__InfluenzaA__ABA87231

SEQ ID NO: 183383 - RNA, 1701 nt, Artificial Sequence; identical to SEQ ID NO: 183279
  derived and/or modified sequence opt5 from hemagglutinin__InfluenzaA__ABA87242

SEQ ID NO: 183384 - RNA, 1701 nt, Artificial Sequence; identical to SEQ ID NO: 183280
  derived and/or modified sequence opt5 from hemagglutinin__InfluenzaA__ABA87253

SEQ ID NO: 183385 - RNA, 1698 nt, Artificial Sequence
  derived and/or modified sequence opt5 from hemagglutinin__InfluenzaA__ABB02781
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcgaucagagaacccuguaccacacagaaaacgcuuaugucagcgugguguccucucauuacagccggcgcuucacccccgagauuacgaaaagaccuaagguccgggaccaggaagggcgcaucaauuauuacuggacacuucuggagcccggagauaccauuaucuuugaggccaacggcaaucucauugcgccuugguaugccuucgcucuguccagaggguuuggaagcggcaucaucacaucuaacgcccccauggacgaaugugaugcuaagugccagaccccgcaaggcgccauuaauuccagccuuccuuuccagaacguucaccccgugaccaucggggaguguccuaaauacgugcggucugcgaagcugcgcauggucacaggacucagaaauauucccagcauccagucccggggccuguuuggggccauugcuggauucaucgaaggcggguggacgggaaugguggacggcugguauggcuaccaucaccagaacgagcaagggucuggauacgccgcugaucagaaaagcacccagaaugccaucaacggcauuacaaauaagguuaacuccgugaucgaaaagaugaauacccaguuuacagccgucgggaaagaguucaacaaacuggagcgcagaauggaaaaucucaacaagaagguggacgauggauuccuggacauuuggaccuauaacgcugagcuucugguucuccuggaaaaugagcggacgcuugacuuucacgauagcaacgugaaaaaucuguacgaaaaggucaaaucucaacucaagaacaaugcgaaagagaucggcaacgggugcuucgaguuuuaucauaaguguaauaacgaaugcauggaguccgugaagaauggcacauacgacuaucccaaauacagcgaagagucuaagcugaaccgcgagaaaauugauggagucaagcuggacuccaugggcguguaucagauccucgccaucuacagcaccguugcuuccucucuggugcuucuggucagccucggggccauuuccuucuggaugugcucuaauggaagccugcaguguagagugugcaucuga

SEQ ID NO: 183386 - RNA, 1698 nt, Artificial Sequence; identical to SEQ ID NO: 183325
  derived and/or modified sequence opt5 from hemagglutinin__InfluenzaA__ABB02792

SEQ ID NO: 183387 - RNA, 1698 nt, Artificial Sequence; identical to SEQ ID NO: 183323
  derived and/or modified sequence opt5 from hemagglutinin__InfluenzaA__ABB02803

SEQ ID NO: 183388 - RNA, 1698 nt, Artificial Sequence
  derived and/or modified sequence opt5 from hemagglutinin__InfluenzaA__ABB02814
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucugccaaacugcgcaugguuaccggccucagaaauauucccagcauccagucccgggggcuguuuggagcuauugccggcuucaucgaagggggauggacaggcaugguggacggcugguauggguaccaucaccagaacgaacaaggaucuggcuacgcugccgaucaaaagagcacgcagaaugccauuaacgggaucaccaauaaagucaacuccgugaucgagaagaugaauacacaguuuaccgcuguuggaaaagaguucaacaagcuggagcgcagaauggagaaucucaacaaaaagguggacgauggcuuccuggacauuuggacauauaacgcggaacuucugguccuccuggagaaugaacggacccuugacuuucacgauagcaacgugaagaaucuguacgagaaagucaagucucagcucaaaaacaaugccaaggaaaucgggaacggcugcuucgaguuuuaucauaaaugugacaaugagugcauggaauccgugaagaacggaacguacgauuaucccaaguacagcgaggaaucuaaacugaaucgcgagaagauugacggcguuaaacuggaguccauggggguguaucagauccucgcuauuuacagcacagucgccuccucucuggugcuucugguuagccucggagccaucuccuucuggaugugcucuaacggcagccugcaguguagaaucugcauuuga

SEQ ID NO: 183389 - RNA, 1698 nt, Artificial Sequence
  derived and/or modified sequence opt5 from hemagglutinin__InfluenzaA__ABB02825
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccauggacgagugugaugccaagugccagacaccgcaaggggcgaucaauuccagccuuccuuuccagaacgugcaccccgucaccaucggagaauguccuaaguacgugcggucugccaaacugcgcaugguuaccggccucagaaauauucccagcauccagucccgggggcuguuuggagcuauugccggcuucaucgaagggggauggacaggcaugguggacggcugguauggguaccaucaccagaacgaacaaggaucuggcuacgcugccgaucaaaagagcacgcagaaugccauuaacgggaucaccaauaaagucaacuccgugaucgagaagaugaauacacaguuuaccgcuguuggaaaagaguucaacaagcuggagcgcagaauggagaaucucaacaaaaagguggacgauggcuuccuggacauuuggacauauaacgcggaacuucugguccuccuggagaaugaacggacccuugacuuucacgauagcaacgugaagaaucuguacgagaaagucaagucucagcucaaaaacaaugccaaggaaaucgggaacggcugcuucgaguuuuaucauaaaugugacaaugagugcauggaauccgugaagaacggaacguacgauuaucccaaguacagcgaggaaucuaaacugaaucgcgagagaauugacggcguuaagcuggaguccauggggguguaucagauccucgcuauuuacagcacagucgccuccucucuggugcuucugguuagccucggagccaucuccuucuggaugugcucuaacggcagccugcagugucggaucugcauuuga

SEQ ID NO: 183390 - RNA, 1701 nt, Artificial Sequence
  derived and/or modified sequence opt5 from hemagglutinin__InfluenzaA__ABB02836
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaaaccaacagacagugauuccgaauaucgggucccggccccgcgucagagauauuccuucucggaucagcaucuacuggaccauugugaaacccggagacauccugcugauuaacuccaccggcaaucucaucgcuccucgcggguacuuuaagauuagaagcggaaagucuuccaucaugcggagcgacgcccccaucggcaaauguaagucugagugcauuacaccgaacggcagcaucccuaaugauaaacccuuccagaacgugaaucgcauuacguauggggcuuguccuagauacgucaagcagaacacccugaaacuugccacaggaaugcggaauguucccgaaaagcaaacccgcggcaucuuuggggcgauugccggauucaucgagaacggcugggaagggaugguggacggaugguauggcuuuagacaccaaaauuccgagggcaucgggcaggcugccgaucugaaaucuacacaggcugccauuaaccagaucaauggaaagcucaaccggcugauuggcaagaccaacgagaaauuccaccagaucgaaaaggaguucagcgaaguggaggggcgcauucaggaccuugaaaaauacgucgaggauacgaagaucgaccugugguccuauaaugccgagcuccugguggcucuggaaaaccaacauacaauugaucucaccgacagcgagaugaauaaacuguuugaaagaaccaagaagcagcuucgggagaacgcggaagauaugggaaauggcugcuucaaaaucuaccacaagugugacaacgccugcaucgggucuauuagaaauggcacauaugaucaugacguuuaccgcgacgaggcucugaacaaucgguuucagaucaaaggaguggagcucaaguccggcuacaaagauuggauucuguggaucagcuucgccauuucuugcuuucuucugugugucgcccuccugggguucaucaugugggcuugccagaagggaaacaucagauguaauauuugcaucuga

SEQ ID NO: 183391 - RNA, 1701 nt, Artificial Sequence
  derived and/or modified sequence opt5 from hemagglutinin__InfluenzaA__ABB02847
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaucggcgugacccagaauggcacauccagcgcuugcaagcgcagaucuaacaauuccuuuuucagccggcugaacuggcucacccaucugaaguuuaaauauccugcccuuaaugucacaaugcccaacaacgagaaguucgacaaacuguacauuuggggagugcaccauccugggaccgauaaugaccagaucucucucuaugcgcaggccuccggccgcauuacgguuagcacaaagagaucccaacagaccgugaucccgaacauugggucucggccccgcgucagagauaucccuagccggaucuccauuuacuggacaaucgugaaacccggagacauucugcugaucaauagcaccggcaaccucauugcuccucgcggguacuuuaagaucagaucuggaaaguccagcaucaugcggucugacgcccccauuggcaaauguaauagcgagugcaucaccccgaacggcuccauuccuaaugauaagcccuuccagaacgugaaucgcaucacauauggggcuuguccuagauacgucaaacagaacacgcugaagcuggccaccggaaugcggaauguucccgaaaaacaaacacgcggcauuuuuggggcgaucgccggauucaucgagaacggcugggaagggaugguggacggaugguauggcuuuagacaccaaaauucugagggcauugggcaggcugccgaucuuaagagcacccaggcugccaucaaccagauuaauggaaaacucaaccggcugaucggcaagacaaacgagaaguuccaccagauugaaaaagaguucuccgaaguggaggggagaauccaggaccuugaaaaguacgucgaggauaccaaaauugaccuguggagcuauaaugccgagcuccugguggcucuggaaaaccaacauacgaucgaucucacagacucugagaugaauaagcuguuugaacgcaccaaaaagcagcuucgggagaacgcggaagauaugggaaauggcugcuucaagaucuaccacaaaugugacaacgccugcauuggguccaucagaaauggcaccuaugaucaugacguuuaccgcgacgaggcucugaacaaucgguuucagauuaagggaguggagcucaaaagcggcuacaaggauuggauccuguggauuucuuucgccaucuccugcuuucuucugugugucgugcuccugggguucaucaugugggccugccagaaaggaaacauuagauguaauaucugcauuuga

SEQ ID NO: 183392 - RNA, 1701 nt, Artificial Sequence; identical to SEQ ID NO: 183071
  derived and/or modified sequence opt5 from hemagglutinin__InfluenzaA__ABB02858

SEQ ID NO: 183393 - RNA, 1701 nt, Artificial Sequence
  derived and/or modified sequence opt5 from hemagglutinin__InfluenzaA__ABB02869
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcccccagaggauauuucaaaauuagaucuggcaagagcuccaucaugcggucuaacgcuccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuguggaaaacgggugggagggaaugguugacggcugguacggguucagacaucaaaauagcgagggaaccggccaggccgcugaucucaaaucuacacaggccgccaucaaccaaauuaauggcaagcugaaccggcuuaucgagaaaaccaaugaaaaguuucaccagaucgaaaaggaguucuccgaaguggaggggcgcauucaggaccuggagaaauaugucgaagauacgaagaucgaccucuggagcuacaacgcugagcugcugguggcgcucgaaaaccagcauacaauugaucugaccgacucugagaugaauaaacuuuucgaacgcacccggaagcaacugagagagaacgccgaggauaugggaaauggcugcuuuaaaaucuaucacaagugugacaacgcuugcauuggguccauccgcaauggaacauacgaucacgacguuuaccgggaugaagcccucaacaauagauuccagauuaagggcguggagcugaaaagcggguauaaggacuggauccuuuggaucuccuuugccauuucuugcuuccugcucugugucgugcugcugggcuuuaucaugugggcuugccagaaaggaaacauucgcuguaauaucugcauuuga

SEQ ID NO: 183394 - RNA, 1701 nt, Artificial Sequence
  derived and/or modified sequence opt5 from hemagglutinin__InfluenzaA__ABB02880
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaaucggaagcugaacagacuuaucgagaaaaccaaugaaaaguuucaccagauugaaaaggaguucuccgaaguugagggccgcauccaggaccuggagaaauauguggaagauacgaagauugaccucuggagcuacaacgcugagcugcuggucgcgcucgaaaaccagcauacaaucgaucugaccgacucugagaugaauaaacuuuucgaacggaccagaaagcaacugcgcgagaacgccgaggauauggggaauggaugcuuuaaaauuuaucacaagugugacaacgcuugcaucggcuccauucggaaugggacauacgaucacgacguguacagagaugaagcccucaacaaucgcuuccagaucaagggaguugagcugaaaagcggcuauaaggacuggauccuuuggauuuccuuugccaucucuugcuuccugcucugugugguccugcugggguuuauuaugugggcuugccagaaaggcaacauccgguguaauauuugcaucuga

SEQ ID NO: 183395 - RNA, 1701 nt, Artificial Sequence
  derived and/or modified sequence opt5 from hemagglutinin__InfluenzaA__ABB02891
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucuaucauuuccaucuacuggacaaucguuaagccuggcgauauucugcucaucaacagcaccgggaaucugauugcuccccggggauauuucaaaauccgcucuggcaagagcuccauuaugagaucuaacgccccuaucggggaauguaauagcgagugcaucacccccaacggauccauuccgaaugacaagccuuuucagaacgugaaucggaucacauacggcgccuguccccgcuaugugaaacagaacacgcuuaagcuggcgaccggcaugagaaaugucccugaaaaacagacacgggggauuuucggagccaucgcuggcuuuauugagaacgggugggagggaaugguggacggcugguacggguuccgccaucaaaauagcgaaggaaccggccaggccgcugaucucaagucuacacaggccgccaucaaccaaaucaauggcaaacugaacagacuuauugagaagaccaaugaaaaauuucaccagaucgagaaggaguucuccgaaguugaggggcggauucaggaccuggaaaaguauguggaggauacgaaaaucgaccucuggagcuacaacgcugaacugcuggucgcgcucgagaaccagcauacaauugaucugaccgacucugaaaugaauaagcuguucgagagaacccgcaaacaacugcgggagaacgccgaagauaugggaaauggcugcuuuaagaucuaucacaaaugugacaacgcuugcauuggguccaucagaaauggaacauacgaucacgacguguaccgcgaugaggcccucaacaaucgguuccagaucaagggcguugaacuuaagagcggguauaaagacuggauucuuuggaucuccuuugccauuucuugcuuccugcucugugugguccugcugggcuuuaucaugugggcuugccagaagggaaacauuagauguaauaucugcaucuga

SEQ ID NO: 183396 - RNA, 1701 nt, Artificial Sequence
  derived and/or modified sequence opt5 from hemagglutinin__InfluenzaA__ABB02902
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugauggacggcugguacggguucagacaucaaaauagcgagggaaccggccaggccgcugaucucaaaucuacacaggccgccauuaaccaaaucaauggcaagcugaaccggcuuaucgagaaaaccaaugaaaaguuucaccagauugaaaaggaguucuccgaaguggaggggagaauccaggaccuggagaaauauguugaagauacgaagauugaccucuggagcuacaacgcugagcugcugguggcgcucgaaaaccagcauacaaucgaucugaccgacucugagaugaauaaacuuuucgaacgcacccggaagcaacugagagagaacgccgaggauaugggaaauggcugcuuuaaaauuuaucacaagugugacaacgcuugcaucggguccauucgcaauggaacauacgaucacgacgucuaccgggaugaagcccucaacaauagauuccagaucaagggcguggagcugaaaagcggguauaaggacuggauccuuuggauuuccuuugccaucucuugcuuccugcucuguguugugcugcugggcuuuauuaugugggcuugccagaaaggaaacauccgcuguaauauuugcaucuga

SEQ ID NO: 183397 - RNA, 1698 nt, Artificial Sequence
  derived and/or modified sequence opt5 from hemagglutinin__InfluenzaA__ABB02913
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcauagaccuccgaacaucggggaucagcgggcccuguaccacacagagaacgcuuaugugagcgucguuuccucucacuacagccgcagauucacccccgaaauugccaagcggccuaaagugcgcgaccaggagggaagaaucaauuauuacuggacgcuucuggaacccggcgauacaauuaucuuugaggcgaacgggaaucucauugccccuugguaugcuuucgcccugucccggggauuuggcagcggcaucauuaccucuaacgcucccauggacgagugugaugccaagugccagacaccgcaaggggcgaucaauuccagccuuccuuuccagaacgugcaucccgucaccaucggagaauguccuaaguacgugcgcucugccaaacugagaaugguuaccggccuccggaauauucccagcauccagucccgcgggcuguuuggagcuauugccggcuucaucgaagggggauggacaggcaugguggacggcugguauggguaccaccaucagaacgaacaaggaucuggcuacgcugccgaucaaaagagcacgcagaaugccauuaacagaaucaccaauaaagucaacuccgugaucgagaagaugaauacacaguuuaccgcuguugggaaagaguucaacaagcuggagcggcgcauggagaaucucaacaaaaagguggacgauggauuccuggacauuuggacauauaacgcggaacuucugguccuccuggagaaugaaagaacccuugacuuucacgauagcaacgugaagaaucuguacgagaaagucaagucucagcucaaaaacaaugccaaggaaaucggcaacgggugcuucgaguuuuaucacaaauguaauaacgagugcauggaauccgugaagaauggcacguacgacuaucccaaguacagcgaggaaucuaaacugaaccgggagaagauugauggaguuaaacuggaguccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183398 - RNA, 1698 nt, Artificial Sequence
  derived and/or modified sequence opt5 from hemagglutinin__InfluenzaA__ABB02924
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacgcugugaucgaaaagaugaauacacaguuuaccgcgguugggaaagaguucaacaaacuggagagacggauggaaaaucucaacaagaagguggacgauggauuccuggacauuuggacauauaacgccgagcuucugguccuccuggaaaaugagcgcacccuugacuuucacgauuccaacgugaaaaaucuguacgaaaaggucaaaagccaacucaagaacaaugcuaaagagaucggcaacgggugcuucgaguuuuaucauaaguguaaugacgaaugcauggagucugugaagaacggcacguacgauuaucccaaauacuccgaagagagcaagcugaauagagagaaaauugacggaguuaagcuggaaucuaugggcguguaucagauccucgccauuuacuccacagucgccagcucccuggugcuucugguuucucucggggcuaucagcuucuggaugugcuccaacggaucucugcagugucggaucugcauuuga

SEQ ID NO: 183399 - RNA, 1698 nt, Artificial Sequence
  derived and/or modified sequence opt5 from hemagglutinin__InfluenzaA__ABB02936
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccugggcauuuugccgacuacgaggaacugagagagcaacucuccucugugagcuccuucgaacgguuugagaucuuccccaagggaagcucuuggccuaaucacaccgucacaggcguguccgcuagcugcucucauaacggcaaguccagcuuuuaucgcaaucugcuuuggcugaccgggaaaaacggacucuaccccaaucugucuauguccuauguuaacaauaaggagaaagaagugcugguccucuggggcgugcaccacccuccgaacaucggggaucagagagcccuguaccauacagagaacgcuuacgugagcgucguuuccucucacuauagccggcgcuucacccccgaaauugccaagagaccuaaagugcgggaccaggagggacgcaucaauuacuauuggacgcuucuggaacccggcgauacaauuaucuuugaggcgaacgggaaucucauugccccuugguacgcuuucgcccuguccagaggauuuggcagcggcaucauuaccucuaacgcucccauggacgagugugaugccaagugccagacaccgcaaggggcgaucaauuccagccuuccuuuccagaacgugcaucccgucaccaucggagaauguccuaaguaugugcggucugccaaacugcgcaugguuaccggccucagaaauauucccagcauccagucccgggggcuguuuggagcuauugccggcuucaucgaagggggauggacaggcaugguggacggcugguacggguaucaccaccagaacgaacaaggaucuggcuacgcugccgaucaaaagagcacgcagaaugccauuaacgggaucaccaauaaagucaacuccgugaucgagaagaugaauacacaguuuaccgcuguuggaaaagaguucaacaagcuggagcgcagaauggagaaucucaacaaaaagguggacgauggcuuccuggacauuuggacauacaacgcggaacuucugguccuccuggagaaugaacggacccuugacuuucaugauagcaacgugaagaaucuguaugagaaagucaagucucagcucaaaaacaaugccaaggaaaucgggaacggcugcuucgaguuuuaccacaaauguaauaacgagugcauggaauccgugaagaauggaacguaugacuaccccaaguauagcgaggaaucuaaacugaaccgcgagaagauugauggcguuaaacuggaguccauggggguguaccagauccucgcuauuuauagcacagucgccuccucucuggugcuucugguuagccucggagccaucuccuucuggaugugcucuaauggcagccugcaguguagaaucugcauuuga

SEQ ID NO: 183400 - RNA, 1701 nt, Artificial Sequence
  derived and/or modified sequence opt5 from hemagglutinin__InfluenzaA__ABB02947
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcaggauuacgcuucucucagaagccugguugccuccagcgggacgcuugaauuuaacaaugagucuuucaacuggaccggaguggcucaaaauggcacauccuaugccugcaaacggcgcagcaucaagucuuucuucuccagacugaacuggcuccaccagcugaaguacaaauaucccgcgcuuaaugucaccaugccuaacaaugacaaguuugauaaacuguacauuuggggcgugcaucaccccagcacagacucugaucagaccucccucuacgcccaggcuagcgggcggguuacgguguccacaaagcgcucucaacagaccgucaucccuaacauuggaagcagaccgugggugcggggcguguccagccgcaucucuauuuauuggacaaucgucaaacccggggacauccugcugauuaacuccaccggaaaucucaucgccccuagaggcuacuucaagauucggagcgggaagucuagcaucaugcgcuccgacgcucccauuggaaaauguaacucugagugcaucaccccuaauggcagcauccccaacgauaagccguuucagaauguuaacagaauuacauauggcgccuguccucgguacgugaaacagaauacgcugaagcuggcgaccgggaugcgcaacgugcccgaaaaacaaacaagaggaaucuucggcgccauugcuggguuuaucgagaauggaugggaaggcauggucgacgggugguauggauuccggcaccagaacuccgagggcaccggccaggccgcugaucuuaagagcacacaagccgccauuaaucagaucaacgggaaacucaauagacugaucgagaagaccaacgaaaaguuucaucagauugagaaagaauuuucugagguggaaggacgcauccaggaccuugagaaguacguugaggauacgaaaauugaccugugguccuauaaugcugaacuccugguggcgcuggagaaccaacacacaaucgaucucaccgacagcgaaaugaacaagcuguucgagcggaccagaaaacagcuucgcgaaaaugccgaggauaugggcaacgggugcuuuaagauuuaccauaagugugacaaugcuugcaucggaucuauucggaacggcacauacgaucacgacgucuauagagacgaggcccugaauaaccgcuuccagaucaaagggguggaacucaaguccggcuacaaagauuggauccuguggauuagcuuugccaucuccugcuuccuucuguguguugugcuccugggauuuauuaugugggcuugccagaagggcaauauccgguguaacauuugcaucuga

SEQ ID NO: 183401 - RNA, 1701 nt, Artificial Sequence; identical to SEQ ID NO: 183210
  derived and/or modified sequence opt5 from hemagglutinin__InfluenzaA__ABB02958

SEQ ID NO: 183402 - RNA, 1701 nt, Artificial Sequence; identical to SEQ ID NO: 183210
  derived and/or modified sequence opt5 from hemagglutinin__InfluenzaA__ABB02969

SEQ ID NO: 183403 - RNA, 1701 nt, Artificial Sequence
  derived and/or modified sequence opt5 from hemagglutinin__InfluenzaA__ABB02980
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucuauuaucuccauuuacuggaccaucgucaaaccuggggauauccugcucauuaauagcacaggaaaccugaucgcuccccggggcuauuucaagauucgcucuggaaagagcuccaucaugagaucugacgccccuauugggaaauguaauagcgaaugcaucacccccaacggcuccaucccgaaugacaagccuuuucagaacguuaaucggauuaccuacggcgccuguccccgcuaugugaaacagaacacacuuaagcuggcgacggggaugagaaaugugccugagaaacaaacccggggaaucuucggcgccauugcuggguuuaucgaaaacggaugggagggcauggucgaugggugguacggauuccgccaccagaauagcgagggcacaggccaggccgcugaccucaagucuacccaagccgccauuaaccagaucaaugggaaacugaacagacuuaucgaaaagacaaaugagaaguuucaucagauugaaaaagaguucuccgaaguggagggacggauccaggaucuggagaaguauguugaagacaccaaaauugaucucuggagcuacaacgcugagcugcugguggcgcucgaaaaccaacacacgaucgaccugacagauucugagaugaauaaacuuuucgaaagaaccaagaagcagcugcgcgagaacgccgaggacaugggcaaugggugcuuuaagauuuaucauaaaugugauaacgcuugcaucggauccauucggaauggcaccuacgaccacgaugucuacagagacgaagcccucaacaaucgcuuccagaucaaggggguggagcugaaaagcggcuauaaggacuggauccuuuggauuuccuuugccaucucuugcuuccugcucuguguugugcugcugggauuuauuaugugggcuugccagaaaggcaacauccgguguaauauuugcaucuga

SEQ ID NO: 183404 - RNA, 1701 nt, Artificial Sequence
  derived and/or modified sequence opt5 from hemagglutinin__InfluenzaA__ABB02991
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacaauccgcaccagauccuggauggggagaacuguacccucaucgacgcccugcugggagauccccauugcgacggcuuucagaauaaagaaugggaucucuucgucgagcggucuaaggccuauagcaacuguuacccuuaugacgugcccgauuacgcuucccugcgcucucuuguugccagcuccgggacgcuggaauuuaauaacgagagcuucaauuggaccggaguggcucaaaacggcacaucuuccgccugcaaaagacggagcaauaaguccuuuuucucucgccucaacuggcugcaccagcuuaaguauaaauacccugcgcugaaugucaccaugcccaacaacgagaaguuugacaaacucuauauuuggggcgugcaucacccuagcacagauucugaccagaucucccuguacgcccaggcuagcgggagaguuaccguguccacgaagcggucucaacagacagucauuccgaauaucggaagccgccccugggugagaggcguguccagcauuaucucuauuuacuggaccaucgucaaaccuggggauauccugcucauuaacuccacaggaaaucugaucgcuccccggggcuauuucaagauucgcagcgggaagucuagcaucaugagauccgacgccccuauuggaaaauguaacucugaaugcaucacccccaauggcagcaucccgaacgacaagccuuuucagaauguuaaccggauuaccuacggcgccuguccccgcuaugugaaacagaauacacuuaagcuggcgacggggaugagaaacgugccugagaaacaaacccggggaaucuucggcgccauugcuggguuuaucgaaaauggaugggagggcauggucgaugggugguacggauuccgccaccagaacuccgagggcacaggccaggccgcugaccucaagagcacccaagccgccauuaaucagaucaacgggaaacugaauagacuuaucgaaaagacaaacgagaaguuucaucagauugaaaaagaguucucugaaguggagggacggauccaggaucuggagaaguauguugaagacaccaaaauugaucucugguccuacaacgcugagcugcugguggcgcucgaaaaucaacacacgaucgaccugacagauagcgagaugaacaaacuuuucgaaagaaccaagaagcagcugcgcgagaaugccgaggacaugggcaacgggugcuuuaagauuuaucauaaaugugauaaugcuugcaucggaucuauucggaacggcaccuacgaccacgaugucuacagagacgaagcccucaauaaccgcuuccagaucaaggggguggagcugaaauccggcuauaaggacuggauccuuuggauuagcuuugccaucuccugcuuccugcucuguguugugcugcugggauuuauuaugugggcuugccagaaaggcaauauccgguguaacauuugcaucuga

SEQ ID NO: 183405 - RNA, 1701 nt, Artificial Sequence
  derived and/or modified sequence opt5 from hemagglutinin__InfluenzaA__ABB03002
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggagcaaggccuauuccaacuguuacccuuaugaugugcccgacuacgcuucucugcgcagccuuguugccuccagcgggacgcuggaauuuaauaacgagucuuucaauuggaccggaguggcucaaaacggcacauccagcgccugcaaaagacggucuaauaaguccuuuuucagccgccucaacuggcugcaccagcuuaaguauaaauacccugcgcugaaugucaccaugcccaacaacgagaaguuugauaaacucuauauuuggggcgugcaucacccuucuacagacuccgaucagaucagccuguacgcccaggcuuccgggagaguuaccgugucuacgaagcggagccaacagacagucauuccgaauaucggauccggccccugggugcgcggggugagcucuagaauuuccaucuacuggaccauugucaaaccuggagacauccugcucaucaacagcacaggcaaucugauugcuccccggggguauuucaagauccgcucuggaaagagcuccauuaugagaucugaugccccuaucggcaaauguaacagcgaaugcauuacccccaauggcuccaucccgaacgacaagccuuuucagaauguuaaccggaucaccuacggggccuguccccgcuaugugaaacagaauacacuuaagcuggcgacgggaaugagaaacgugccugagaaacaaacccggggcauuuucggggccaucgcuggauuuauugaaaauggcugggaggggauggucgacggaugguacggcuuccgccaccagaacagcgagggcacagggcaggccgcugaucucaagucuacccaagccgccaucaaucagauuaacggaaaacugaauagacuuaucgaaaagacaaacgagaaguuucaucagaucgaaaaagaguucuccgaaguggagggccggauucaggaccuggagaaguauguugaagauaccaaaaucgaccucuggagcuacaacgcugagcugcugguggcgcucgaaaaucaacacacgauugaucugacagacucugagaugaacaaacuuuucgaaagaaccaagaagcagcugcgcgagaaugccgaggauauggggaacggaugcuuuaagaucuaucauaaaugugacaaugcuugcauuggcuccauccggaacgggaccuacgaucacgacgucuacagagaugaagcccucaauaaccgcuuccagauuaagggcguggagcugaaaagcggauauaaggacuggauccuuuggaucuccuuugccauuucuugcuuccugcucuguguugugcugcugggcuuuaucaugugggcuugccagaaagggaauauucgguguaacaucugcauuuga

SEQ ID NO: 183406 - RNA, 1701 nt, Artificial Sequence
  derived and/or modified sequence opt5 from hemagglutinin__InfluenzaA__ABB03013
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucacaaugcccaauaacgacaaguucgauaaacucuauaucuggggcgugcaucacccugggacagacucugaucagaccucccuguacgcccaggcuagcggacggguuacgguguccacaaagcgcucucagcaaaccgucauuccgaauaucggcagcgggcccugggugagaggaguguccagccggauuucuaucuacuggacaauugucaaaccuggcgacauccugcucaucaacuccaccgggaaccugauugcccccagaggauauuuuaagaucagaagcggcaagucuagcauuaugcgguccgacgcuccuaucggcaaauguaauucugagugcauuacccccaacgggagcaucccgaaugauaagccuuuccagaacguuaaucgcaucacauacggagccugucccagauaugugaaacagaacacgcuuaagcuggcgaccggcaugcggaaugugccugaaaaacagacacgcgggauuuuuggagccaucgcuggcuucauugagaacgggugggaaggaauggucgacggcugguacggcuuuagacaccaaaauuccgaggggaccggacaggccgcugaucucaagagcacacaggccgccaucaaccaaauuaauggcaaacugaaccggcuuaucgagaagaccaaugaaaaguuccaucagaucgagaaagaguucacggaaguggaagggcgcauucaggaccuggagaaguauguugaggauacaaaaaucgaccucuggucuuacaacgcugaacugcugguggcgcucgagaaucagcacaccauugaucugaccgacuccgaaaugaacaaacuuuuugagcgcacacggaagcaacugagagaaaacgccgaggauaugggaaauggcugcuucaagaucuaucauaagugugacaacgcuugcauugggagcauccgcaauggcaccuacgaucacgacgucuaccgggacgaggcccucaacaauagauuucagauuaaaggaguggaacugaagucuggcuauaaagauuggauccuuuggaucuccuucgccacaagcugcuuucugcucuguguugugcugcugggguucauuaugugggcuugccagaagggaaacauccgcuguaauauuugcaucuga

SEQ ID NO: 183407 - RNA, 1701 nt, Artificial Sequence
  derived and/or modified sequence opt5 from hemagglutinin__InfluenzaA__ABB03024
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccuggauuagaggcgugagcucucggaucuccauuuacuggaccaucgugaaaccuggggauauccugcucauuaauagcacaggaaaccugaucgcuccccgcggcuauuucaagauuagaucuggaaagagcuccaucaugcggucugacgccccuauugggaaauguaauagcgaaugcaucacccccaacggcuccaucccgaaugacaagccuuuucagaacgucaaucgcauuaccuacggcgccugucccagauauguuaaacagaacacacuuaagcuggcgacggggaugcggaaugugccugagaaacaaacccgcggaaucuucggcgccauugcuggguuuaucgaaaacggaugggagggcaugguggaugggugguacggauucagacaccagaauagcgagggcacaggccaggccgcugaccucaagucuacccaagccgccauuaaccagaucaaugggaaacugaaccggcuuaucgaaaagacaaaugagaaguuucaucagauugaaaaagaguucuccgaagucgagggaagaauccaggaucuggagaaguauguggaagacaccaaaauugaucucuggagcuacaacgcugagcugcugguugcgcucgaaaaccaacacacgaucgaccugacagauucugagaugaauaaacuuuucgaacgcaccaagaagcagcugcgggagaacgccgaggacaugggcaaugggugcuuuaagauuuaucauaaaugugauaacgcuugcaucggauccauuagaaauggcaccuacgaccacgauguguaccgcgacgaagcccucaacaaucgguuccagaucaagggggucgagcugaaaagcggcuauaaggacuggauccuuuggauuuccuuugccaucucuugcuuccugcucugugugguucugcugggauuuauuaugugggcuugccagaaaggcaacaucagauguaauauuugcaucuga

SEQ ID NO: 183408 - RNA, 1701 nt, Artificial Sequence
  derived and/or modified sequence opt5 from hemagglutinin__InfluenzaA__ABB03035
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcagaauuugcgacagcccgcaccggauccuggauggggagaacuguacccucaucgacgcccugcugggagauccccauugcgacggcuuucagaauaaagaaugggaucucuucgucgagcgcuccaaggccuauucuaacuguuacccuuaugacgugcccgauuacgcuagccugagaucccuuguugccagcucugggacgcuggaauuuaauaacgaguccuucaauuggaccggaguggcucagaacggcaccagcuuugccugcaaacggcgcucuauuaaguccuucuuuagcagacucaauuggcugcaccaacuuaaguauaaauacccugcgcugaacgucgccaugcccaauaacgacaaguucgauaaacucuauaucuggggcgugcaucacccugggacagacucugaucagacaucccuguacgcucaggccagcggacggguuaccguguccacgaagcgcucucagcaaacagucauuccgaauaucggcagcagacccugggugcgcgggguguccagccggauuucuaucuacuggaccauugucaaaccuggagacauccugcucaucaacuccacaggcaaccugauugcucccagaggguauuuuaagauccggagcggaaagucuagcauuaugcgcuccgacgccccuaucggcaaauguaauucugagugcauuacccccaacggcagcaucccgaaugauaagccuuuccagaacguuaauagaaucaccuacggggcguguccccgguaugugaaacagaacacacuuaagcuggccacgggaaugcgcaaugugccugaaaaacagaccagaggcauuuuuggggcuaucgccggauucauugagaacggcugggaagggauggucgacggaugguacggcuuucggcaccaaaauuccgagggcacagggcaggcugccgaucucaagagcacccaggccgcuaucaaccaaauuaauggaaaacugaacagacuuaucgagaagacaaaugaaaaguuccaucagaucgagaaagaguucaccgaaguggaaggccgcauucaggaccuggagaaguauguugaggauacgaaaaucgaccucuggucuuacaacgcggaacugcugguggcccucgagaaucagcacacaauugaucugaccgacuccgaaaugaacaaacuuuuugagcggaccagaaagcaacugcgcgaaaacgcugaggauauggggaauggaugcuucaagaucuaucauaagugugacaacgccugcauuggcagcauccggaaugggacauacgaucacgacgucuacagagacgaggcccucaacaaucgcuuucagauuaaaggcguggaacugaagucuggauauaaagauuggauccuuuggaucuccuucgcuaccagcugcuuucugcucuguguugugcugcugggcuucauuaugugggccugccagaaggggaacauccgguguaauauuugcaucuga

SEQ ID NO: 183409 - RNA, 1701 nt, Artificial Sequence
  derived and/or modified sequence opt5 from hemagglutinin__InfluenzaA__ABB03046
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucugggauuuccaucuacuggaccauugucaaaccuggagauauccugcucaucaauagcacaggcaaccugauugcuccccggggguauuucaagauccgcucuggaaagagcuccauuaugagaucugacgccccuaucggcaaauguaauagcgaaugcauuacccccaacggcuccaucccgaaugacaagccuuuucagaacguuaaucggaucaccuacggggccuguccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccagaauagcgagggcacagggcaggccgcugaccucaagucuacccaagccgccaucaaccagauuaauggaaaacugaacagacuuaucgaaaagacaaaugagaaguuucaucagaucgaaaaagaguucuccgaaguggagggccggauucaggaucuggagaaguauguugaagacaccaaaaucgaucucuggagcuacaacgcugagcugcugguggcgcucgaaaaccaacacacgauugaccugacagauucugagaugaauaaacuuuucgaaagaaccaagaagcagcugcgcgagaacgccgaggacauggggaauggaugcuuuaagaucuaucauaaaugugauaacgcuugcauuggcuccauccggaaugggaccuacgaccacgaugucuacagagacgaagcccucaacaaucgcuuccagauuaagggcguggagcugaaaagcggauauaaggacuggauccuuuggaucuccuuugccauuucuugcuuccugcucuguguugcucugcugggcuuuaucaugugggccugccagaaagggaacauucgguguaauaucugcauuuga

SEQ ID NO: 183410 - RNA, 1701 nt, Artificial Sequence
  derived and/or modified sequence opt5 from hemagglutinin__InfluenzaA__ABB03057
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcagucuagcuccacaggcgggaucugcgacucuccgcaccagauccuugauggagaaaauuguacccugauugacgcccuccugggcgauccccagugcgacggguuucaaaacaagaaaugggaucuguucgucgagagaagcaaggccuauuccaauuguuacccuuaugacgugcccgauuacgcuucucuccggagccugguugccuccagcggaacgcuugaauuuaacaaugagucuuucaacuggaccggcgugacacagaauggcaccuccagcgcuugcaaacgcagaucuaacaauuccuuuuucagccggcugaacuggcucacacaucugaaguuuaaguauccugcccuuaaugucaccaugcccaacaacgagaaauucgacaagcuguacaucuggggagugcaccauccugggacggauaaugaccagacaucucucuaugcgcaggccuccggccgcauuaccguuagcacaaaaagaucccaacagaccgugaucccgaacauugggucucggccccgcgucagagauaucccuagccggauuuccaucuacuggaccaucgugaagcccggagacauucugcugaucaauagcacaggcaaccucauugcuccucgcggguacuuuaaaaucagaucuggaaaguccagcauuaugcggucugacgcccccaucggcaaguguaauagcgaaugcaucacgccgaacggcuccauuccuaaugauaaacccuuccagaacgugaaucgcaucaccuauggggcuuguccuagauacgucaagcagaacacacugaaacuugccaccggaaugcggaauguucccgagaagcaaacacgcggcauuuuuggggcgaucgccggauucauugaaaacggcugggaggggaugguggacggaugguauggcuuuagacaccaaaauucugagggcaucgggcaggcugccgaucugaaaagcacccaggcugccaucaaccagauuaauggaaagcucaaccggcugaucggcaaaacgaacgaaaaguuccaccagauugagaaggaguucuccgaaguggaagggagaauccaggaccuugagaaauacgucgaggauacaaagauugaccuguggagcuauaaugccgaacuccugguggcucuggagaaccaacauaccaucgaucucaccgacucugaaaugaauaaacuguuugagcgcacaaagaaacagcuucgggaaaacgcggaggauaugggaaauggcugcuucaagauuuaccacaagugugacaacgccugcaucggguccaucagaaauggcaccuaugaucaugacguuuaccgcgacgaggcucugaacaaucgguuucagauuaaaggaguggaacucaagcugggcuacaaagauuggauccuuuggauuagcuucgccaucucuugcuuucugcucugugucgcccugcugggguucauuaugugggcuugccagaagggaaacaucagauguaauaucugcauuuga

SEQ ID NO: 183411 - RNA, 1701 nt, Artificial Sequence; identical to SEQ ID NO: 183310
  derived and/or modified sequence opt5 from hemagglutinin__InfluenzaA__ABB03068

SEQ ID NO: 183412 - RNA, 1701 nt, Artificial Sequence; identical to SEQ ID NO: 183267
  derived and/or modified sequence opt5 from hemagglutinin__InfluenzaA__ABB03079

SEQ ID NO: 183413 - RNA, 1701 nt, Artificial Sequence; identical to SEQ ID NO: 183267
  derived and/or modified sequence opt5 from hemagglutinin__InfluenzaA__ABB03090

SEQ ID NO: 183414 - RNA, 1698 nt, Artificial Sequence
  derived and/or modified sequence opt5 from hemagglutinin__InfluenzaA__ABB03101
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaaaagagcucuuggccuaaucauacggucaccggaguguccgcuagcugcucucacaacggcaaguccagcuuuuaccgcaaucugcuuuggcugacaggcaagaacgggcucuaucccaaucugucuaaauccuacgccaacaauaaggagaaagaaguucugauucucuggggagugcaucacccuccgaacaucggcgaucagagaacccuguaccacacagagaacgcuuaugucagcgugguguccucucauuacagccggcgcuucacccccgaaauuacgaagagaccuaagguccgggaccaggaggggcgcaucaauuauuacuggacacuucuggaacccggagauaccauuaucuuugagacaaacggcaaucucauugccccuugguaugcguucgcccuguccagaggguuuggaagcggcaucaucaccucuaacgcucccauggacgagugugaugccaaaugccagaccccgcaaggcgcuauuaauuccagccuuccuuuccagaacguucaccccgugacaaucggggaauguccuaaguacgugcggucugccaaacugcgcauggucacgggacucagaaauauucccagcauccagucccggggccuguuuggggcgauugccggauucaucgagggcggguggaccggaaugguggacggcugguauggcuaccaucaccagaacgaacaagggucuggauacgcugccgaucaaaagagcacacagaaugcuaucaacggcauuaccaauaaaguuaacuccgugaucgagaagaugaauacacaguuuaccgccgucgggaaagaguucaacaagcuggaacgcagaauggagaaucucaacaagaaaguggacgauggauuccuggacauuuggacguauaacgccgaacuucugguucuccuggagaaugaacggacacuugacuuucacgauagcaacgugaagaaucuguacgagaaagucaagucucagcucaaaaacaaugcuaaggaaaucggcaacgggugcuucgaguuuuaucauaaguguaauaacgagugcauggaauccgugaaaaauggcaccuacgacuaucccaaguacagcgaggaaucuaaacugaaccgcgagaagauugauggagucaaacuggacuccaugggcguguaucagauccucgcgaucuacagcaccguugccuccucucuggugcuucuggucagccucggggcuauuuccuucuggaugugcucuaauggaagccugcaguguagaaucugcauuuga

SEQ ID NO: 183415 - RNA, 1701 nt, Artificial Sequence
  derived and/or modified sequence opt5 from hemagglutinin__InfluenzaA__ABB03112
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuucccucuacgcgcaggccagcggccgcaucacaguuuccaccaaaagaucucaacagacagugauuccgaacaucgggagccggccccgcgucagagauguguccagccggauuucuaucuacuggaccaucgugaagccuggagacauucugcugaucaauuccaccggcaaccucauugcuccccgcggguauuucaagaucagaagcggaaaaucuagcauuaugcgguccgacgccccuaucggcaaguguaauucugagugcaucacacccaacggcagcauuccgaaugauaaaccuuuucagaacgucaauaagaucacguacggggcuuguccccgcuauguuaaacagaacacccugaagcuggccacaggaaugagaaaugugccugaaaaacaaacccggggcauuuucggggcgaucgccggauuuauugagaacggcugggaagggaugguggacggaugguacggcuuccgccaccagaacuccgagggcacagggcaggcugccgaucuuaagagcacccaagcugccaucaaccagaucaauggaaagcucaacagacugauuggcaaaacgaaugagaaguuucaccagaucgaaaaagaguucucugaagucgaggggcggauucaggaccuugaaaaguauguggaggauacaaaaaucgaccugugguccuacaacgccgagcuccugguugcucuggaaaaccaacauaccauugaucucaccgacagcgagaugaauaagcuguucgaaagaacaaagaaacagcuucgcgagaacgcggaagauaugggaaauggcugcuuuaagaucuaucacaaaugugacaauaccugcauugagucuauccggaaugggacauacgaucaugacguguacagagacgaggcccugaacaaucgcuuccagaucaagggcgucgaacucaaauccggauauaaggauuggauucuguggaucagcuuugcuauuuccugcuuccuucuguguguggcccuccugggcuuuaucaugugggccugccagaaggggaacauucgguguaauaucugcaucuga

SEQ ID NO: 183416 - RNA, 1698 nt, Artificial Sequence
  derived and/or modified sequence opt5 from hemagglutinin__InfluenzaA__ABB03123
augaaggugaaacugcucguccugcuuugcaccuucacagccacguacgcugacaccaucuguauuggcuaucacgccaacaauagcacagauaccguugacacagugcuggagaagaacgugaccgucacacauuuugugaaucuccuggaagauucccacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuucgccgacuaugaggaacugagagagcaacucagcuccgucucuagcuuugaacgguucgagaucuuucccaaggaguccagcuggccuaaucauaccgugacaggaguuucugccuccugcagccacaacggcaagucuuccuucuaccgcaaucugcuuuggcugaccggcaaaaacgggcucuaucccaaucugagcaagucuuacgcuaacaauaaagaaaaggaggugcugguccucuggggagugcaucacccuccgaacaucggcgaucagagagcccuguaccacacagaaaacgcuuauguguccgucguuagcucccauuacucucggcgcuuuacccccgagauugccaaaagaccuaaggugcgggaccaggaagggcgcaucaauuauuacuggacgcuucuggagcccggagauacaauuaucuucgaggcgaacggcaaucucauugccccuagauaugcuuuugcccugagccggggguucggauccggcaucauuaccagcaacgcucccauggacgaaugugaugccaagugccagacaccgcaaggcgcgaucaauucuucccuuccuuuucagaacgugcaccccgucaccaucggggaguguccuaaauacgugcgcagcgccaagcugagaaugguuaccggacuccggaauauucccucuauccagagccgcggccuguucggggcuauugccggauuuaucgaaggcggguggacaggaaugguggacggcugguauggcuaccaucaccagaacgagcaaggguccggauacgcugccgaucagaaaucuacgcagaaugccauuaacggcaucaccaauaaggucaacagcgugaucgaaaagaugaauacacaguucaccgcuguugggaaagaguucaacaaacuggagagacggauggaaaaucucaacaagaagguggacgauggauuucuggacauuuggacauauaacgcggagcuucugguccuccuggaaaaugagcgcacccuugacuuccacgauuccaacgugaaaaaucuguacgaaaaggucaaaagccaacucaagaacaaugccaaagagaucggcaacgggugcuuugaguucuaucauaaguguaaugacgaaugcauggagucugugaagaacggcacguacgauuaucccaaauacuccgaagagagcaagcugaauagagagaaaauugacggaguuaagcuggaaucuaugggcguguaucagauccucgcuauuuacuccacagucgccagcucccuggugcuucugguuucucucggggccaucagcuuuuggaugugcuccaacggaucucugcagugucggaucugcauuuga

SEQ ID NO: 183417 - RNA, 1698 nt, Artificial Sequence
  derived and/or modified sequence opt5 from hemagglutinin__InfluenzaA__ABB03134
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccgagaaaaacggccucuaucccacacugucuaaguccuacgcuaauaacaaagaaaaggaaguucugauucucuggggagugcaucacccuccgaauaucggggaucagagaacccuguaccacacggagaacgccuaugucagcgugguguccucucauuacagccggcgcuucacacccgaaauuaccaaaagaccuaagguccgggaccaggagggccgcaucaacuauuacuggacacuucuggagcccggggauaccauuaucuuugaagcuaauggaaaccucauugccccuugguaugcguucgcccuguccagaggcuuugggagcggaaucaucaccucuaaugcucccauggacgagugugaugccaagugccagacaccgcaaggcgcuauuaacuccagccuuccuuuccagaauguucaccccgugacgaucggcgaauguccuaaauacgugcggucugccaagcugcgcauggucaccgggcucagaaacauucccagcauccagucccggggacuguuuggcgcgauugccggguucaucgagggaggcuggacagggaugguggacggaugguauggcuaccaucaccagaaugaacaaggcucuggguacgcugccgaucagaaaagcacccagaacgcuaucaauggaauuacaaacaagguuaauuccgugaucgagaaaaugaacacccaguuuacggccgucggcaaggaguucaauaaacuggaacgcagaauggagaaccucaauaagaagguggacgauggguuccuggacauuuggacauauaacgccgaacuucugguucuccuggagaacgaacggacccuugacuuucacgauagcaaugugaaaaaccuguacgagaaggucaaaucucaacucaagaauaacgcuaaagagaucggaaauggcugcuucgaauuuuaucauaaguguaacaaugagugcauggaauccgugaagaacgggaccuacgacuaucccaaauacagcgaggagucuaagcugaaucgcgagaaaauugauggcgucaagcuggaauccaugggaguguaucagauccucgcgaucuacagcacaguugccuccucucuggugcuucuggucagccucggcgcuauuuccuucuggaugugcucuaacgggagccugcaguguagaaucugcauuuga

SEQ ID NO: 183418 - RNA, 1698 nt, Artificial Sequence; identical to SEQ ID NO: 183323
  derived and/or modified sequence opt5 from hemagglutinin__InfluenzaA__ABB03145

SEQ ID NO: 183419 - RNA, 1701 nt, Artificial Sequence
  derived and/or modified sequence opt5 from hemagglutinin__InfluenzaA__ABB04283
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuauuaaugaaggauucaacuggaccggcgugacacagucuggcggguccuacgcuugcaaacggggaagcgacaagucuuucuucucccgccugaauuggcucuaugagagcgagucuaaguacccugcccugaacgucaccaugcccaauaacggcaauuuugauaaacuuuauaucuggggagugcaccauccuuccacagacaaggaacaaaccaaccuguacguuagagcgagcgggcgggugacggucuccacaaaacgcucucagcagaccauuaucccgaacauuggccccagaccuugggugcgggggcucagcucccgcaucagcauuuacuggacaaucgugaagcccggagauauccugcugauuaauucuuccggcaaccucaucgccccuagaggcuauuucaaaauucggaccggaaagagcucuaucaugcgcagcgacgcucccauugggaccuguuccucugagugcaucacaccgaauggcagcaucccuaacgacaagcccuuucagaaugucaacaaaauuacguacggggccuguccuaaguauguuaaacaaaauacccugaagcuggcuacaggaaugagaaacauccccgaaaaacagacccggggcauuuucggggccaucgcgggauuuauugagaauggcugggagggcaugguggaugggugguacggauuccgccaccagaacuccgaaggcacagggcaggccgcugaccuuaagagcacccaagccgcuaucgaucagaucaauggaaaacucaacagagugauugagaagacgaaugaaaaguuccaccagaucgagaaagaauuuucugaggucgagggccggauucaagaccuggaaaaguauguggaggauacaaaaaucgaccuuugguccuacaacgccgaacugcucguugcccuggagaaucagcauaccauugaucugaccgacagcgaaaugaacaagcucuuugagaaaacaagacgccagcugcgggagaacgcugaagauauggggaauggcugcuuuaagaucuaucacaagugugacaacgcgugcauuggaucuaucagaaauggcaccuacgaucaugacguguaccgcgacgaggcccuuaacaaucgguuccagaucaaaggggucgaacugaaguccggauauaaagauuggauucucuggaucagcuuugcuauuuccugcuuccugcuuugugugguucugcucggcuuuaucaugugggccugccaaaaggggaacauuagauguaauaucugcaucuga

SEQ ID NO: 183420 - RNA, 1701 nt, Artificial Sequence
  derived and/or modified sequence opt5 from hemagglutinin__InfluenzaA__ABB04294
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucaauuguacccucauugacgcucugcugggcgauccccauugcgacggguuucagaacgagaaaugggaucucuucgucgaacggucuaaggccuuuagcaauuguuauccuuacgacgugcccgauuaugccucccugcgcucucuuguugcuagcuccggaacgcuggaguucaucaacgaaggcuuuaauuggaccggcgugacacagaacgggggaagcaaugccugcaaaagaggcccugacucuggguucuuuucccggcucaacuggcuguacaagagcggaucuaccuaucccguccuuaaugugacaaugccuaacaacgauaauuucgacaagcuguacauuuggggcguucaccauccguccaccgaucaagagcagacgaaccucuaugugcaggcuagcgggcgcgucacagugucuaccaaaagaucccagcaaacaaucauucccaauaucggaagccggccuugggugcgcggccuguccucuagaauuagcaucuacuggaccaucgucaagcccggcgacauucugguuaucaacuccaaugggaaccucauugccccucggggauacuuuaaaaugcgcaccggcaagagcucuaucaugagauccgacgcgcccauugggacauguaucagcgagugcaucacgccgaauggaucuauuccuaacgauaaacccuuccagaaugugaacaagaucaccuauggcgccuguccuaaguacgugaaacagaauacacugaaacuugcuaccgggaugcggaacguccccgaaaagcagacacgcggaauuuuuggcgccaucgcuggcuucauugagaaugggugggaaggaaugaucgacggcugguauggguuuagacaccaaaacagcgagggaaccggccaggccgcggaucugaaguccacgcaggccgcuaucgaccaaauuaaugggaaacucaaccgggugaucgagaagacaaacgaaaaauuccaccagauugagaaggaguucucugaaguugaaggccgcauccaggaucuggagaaguacguggaggacaccaaaauugaucuuuggagcuauaaugccgaacugcucgucgcucuggagaaccagcauaccaucgaccugacagauuccgaaaugaauaagcucuuugagaaaaccagacggcaacugagagaaaacgccgaggacaugggaaauggcugcuucaagauuuaccacaaaugugauaacgccugcaucgggagcauccgcaauggaacauaugaccaugacguguaccgggaugaggcucuuaacaauagauuucagauuaagggcguugaacugaagucuggguacaaagacuggauccucuggauuuccuucgcgaucagcugcuuucugcuuugugugguccugcucggauucauuaugugggccugccagaagggcaacauccgcuguaauaucugcauuuga

SEQ ID NO: 183421 - RNA, 1701 nt, Artificial Sequence
  derived and/or modified sequence opt5 from hemagglutinin__InfluenzaA__ABB04305
augaagaccaucauugcccugagcuacaucuucugccucguguuugcucagaaacugcccgagaacgacaauuccacagccacgcuuugucugggccaccaugcggucccuaacgggacccucguuaagacaauuaccaaugaucaaaucgaagugacaaacgcuaccgagcuggugcagucuagcuccacaggaagaauuugcgacucuccgcaccggauccuugauggcaaaaauuguacccugaucgacgcccuccugggggauccccauugcgacggauuccagaacgaaaagugggaucuguuugucgagcgcagcaaagccuucuccaauuguuauccuuacgacgugcccgauuaugcuucucucagaagccugguugccuccagcggcacgcuugaauuuauuaacgagggguucaauuggaccggagugacacagucuggcggcuccuacgcuugcaagcgggggagcgucaacuccuuuuucucucgccugaauuggcucuauaagagcgagucuaaauacccugugcugaacguuaccaugcccaauaacggaaaguuugacaaacuuuauaucuggggcgugcaccauccuuccacagauaaggaacaaaccaaucuguacgucagagccagcgggaaagugacgguguccacaaagcggucucagcagaccgucauuccgaacaucggaagccgccccuggguuagaggccucuccagccggauuucuaucuacuggacaauugugaagccuggggacauccugcugaucaacuccaccggaaaucucauugcgccccgcggcuauuucaaaaucagaaccggcaagagcucuauuaugcggagcgaugccccuaucgggacauguuccucugagugcauuacgcccaacggaagcaucccgaaugacaaaccuuuucagaacgugaauaagaucaccuacggcgcuuguccccgcuaugucaaacaaaacacacugaagcuggccaccgggaugagaaaugugccugaaaaacagacacggggaauuuucggcgcuaucgccggguuuauugagaacggaugggagggcaugguugacggcugguacggguuccgccaccaaaauuccgaaggaaccggccaggcggccgaucuuaagagcacgcaggcugccaucgaccagauuaacgggaagcucaauagacugaucgagaaaacaaacgaaaaguuccaccagaucgagaaagaauuuucugagguggagggacggauucaagaucuugaaaaguaugucgaggacaccaaaaucgaucugugguccuacaaugcugaacuccugguggcccuggagaaccagcauaccauugaccucacagauagcgaaaugaauaagcuguucgagaagaccagaaaacagcuucgcgagaacgccgaagacaugggcaacgggugcuuuaagaucuaucacaaaugugauaaugcuugcauuggcucuauccggaacggaacauacgaccaugauguuuacagagacgaggcgcugaauaaccgcuuccagauuaagggcguggaacucaaauccggguauaaggacuggauccuguggaucagcuuugccauuuccugcuuccuucugugugucgugcuccugggauuuaucaugugggcuugccaaaagggcaauauucgguguaacaucugcauuuga

SEQ ID NO: 183422 - RNA, 1701 nt, Artificial Sequence
  derived and/or modified sequence opt5 from hemagglutinin__InfluenzaA__ABB04316
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaagucuuucuuuucccgccugaacuggcuccacgagagcgaguacaaauauccugcccugaaugugaccaugcccaacaauggaaaguucgauaaacuuuacaucuggggcguucaucacccuucuacagacagagaacaaaccaaccuguacgugcgggcguccgggcgcgucacggugagcacaaagagaucccagcagaccgugauuccgaauaucggaucucggcccuggguccgcggccucagcuccagaauuagcaucuauuggacaauuguuaaaccuggggauauccugcugaucaacucuaccggaaaccucauugcuccccggggcuacuuuaagauccgcaccggcaaguccagcauuaugagaucugacgccccuaucgggacauguagcuccgagugcauuacgcccaauggaucuaucccgaacgacaaaccuuuccagaaugugaacaagaucaccuauggcgccuguccccgguacgugaaacaaaauacacugaaacuugcuaccgggaugcgcaacgucccugaaaagcagacaagaggaauuuuuggcgccaucgcgggguucauugagaauggaugggagggcaugguggauggcugguauggguuucggcaccagaacagcgaaggaaccggccaggccgcugaccugaaguccacgcaagccgcuaucgaucagauuaaugggaaacucaacagacugaucgagaagacaaaugaaaaguuccaucagaucgagaaagaguucagcgaaguugagggacgcauucaagaccuugaaaaguacguggaggauaccaaaaucgaccuguggucuuauaacgccgaacuccuggucgcccuggagaaucagcacaccauugaucucacagacuccgaaaugaacaagcuguuugagaaaacccggaagcagcuuagagagaaugcugaagauaugggcaacgggugcuucaagaucuaccauaaaugugacaacgcgugcauuggcagcauccgcaauggaacauacgaucacgacguguaucgggacgaggcccugaacaauagauuucagauuaagggcguugaacucaaaucuggguacaagaacuggauccuguggaucuccuucgcuauuagcugcuuucuucugugugugguccuccugggauucaucaugugggccugccaaaaaggcaauauucgcuguaacaucugcauuuga

SEQ ID NO: 183423 - RNA, 1701 nt, Artificial Sequence
  derived and/or modified sequence opt5 from hemagglutinin__InfluenzaA__ABB04327
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuauaagagcgaguacaaauauccugcccugaacgugaccaugcccaauaacggcaaguuugacaaacuuuacaucuggggaguucaccauccuucuacagagaaggaacaaaccaaucuguacgugagagcguccgggcgggucacggugagcacaaaacgcucccagcagaccgugauuccgaacaucggcucuauucccugggucagagggcucagcucccggaucagcauuuauuggacaaucguuaagccuggagauauccugcugauuaacucuaccggcaaucucaucgcuccccgcggcuacuucaagauuagaaccgggaaauccagcaucaugcggucugacgccccuauuggaacauguagcuccgagugcaucacgcccaacggcucuaucccgaaugauaagccuuuucagaacgugaauaaaauuaccuauggggccuguccccgcuacgugaagcaaaacacacugaaacuugcuaccggaaugagaaaugucccugaaaagcagacacggggcaucuucggggccauugcgggauuuaucgagaacggcugggagggcaugguggacgggugguauggauuccgccaccagaauagcgaaggcaccgggcaggccgcugaccugaaauccacgcaagccgcuauugaucagaucaacggaaagcucaauagacugaucgagaagacaaacgaaaaauuccaccagauugagaaggaauuuagcgagguugagggccggauccaagaccuugaaaaauacguggaggauaccaagauugaccuguggucuuauaaugccgaacuccuggucgcccuggagaaccagcauaccaucgaucucacagacuccgaaaugaauaaacuguucgagaagaccagaaagcagcuucgcgagaacgcugaagauauggggaacggcugcuuuaaaauuuaccacaagugugacaaugcgugcaucggaagcauucggaacggcacauacgaucaugacguguauagagaugaggcccugaauaaccgcuuccagaucaaagggguugaacucaagucuggauacaaagacuggauccuguggauuuccuuugcuaucagcugcuuccuucugugugugguccuccugggcuuuauuaugugggccugccaaaaggggaauauccgguguaacauuugcaucuga

SEQ ID NO: 183424 - RNA, 1701 nt, Artificial Sequence
  derived and/or modified sequence opt5 from hemagglutinin__InfluenzaA__ABB04338
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauucuggguuuuucucccggcugaacuggcucuacaaaagcggaucuaccuaucccguccugaaugugacgaugccuaacaaugacaacuuugauaaacuuuacauuuggggcguucaccauccguccacagaccaagagcagaccagccuguaugugcaggcuucugggcgcgucacaguguccaccaagagaagccagcaaaccaucauucccaacaucggaucccggccuugggugcgcggccucucuagcagaauuuccaucuacuggacaaucgucaagcccggcgacauucugguucugaauagcaacgggaaucucaucgccccucggggauacuucaagaugcgcacgggcaaaucuuccauuaugagaagcgaugcgcccaucgggaccuguauuucugagugcaucacaccgaacggaagcaucccuaaugacaagcccuuucagaacgugaauaaaauuaccuauggcgccuguccuaaguacgugaagcagaacacacugaaacuugcuaccgggaugcggaauguccccgaaaagcagacgcgcggacuguucggcgccaucgcuggcuuuauugagaacgggugggaaggaaugaucgauggcugguauggguucagacaccaaaauuccgagggaacaggccaggccgcggaccucaaaucuacccaggccgcuauugaucaaaucaacgggaagcugaaucgggugaucgagaaaaccaacgaaaaguuccaccagauugagaaagaauuuagcgagguugaaggccgcauccaggaccuugagaaguacguggaggauacaaagauugaccugugguccuauaaugccgaacuccuggucgcucuggagaaccagcauaccaucgaucucacagacagcgaaaugaacaaacuguucgagaagacgagacggcaacuuagagaaaaugccgaggauaugggaaacggcugcuuuaaaauuuaccacaagugugacaaugccugcaucgggucuauucgcaacggaaccuaugaccaugauguguaccgggacgaggcucugaauaacagauuccagaucaaaggcguugaacucaaguccggguacaaggauuggauccuguggauuagcuuugcgaucucuugcuuccuucugugugugguccuccugggauuuauuaugugggccugccagaaaggcaauauccgcuguaacauuugcaucuga

SEQ ID NO: 183425 - RNA, 1701 nt, Artificial Sequence
  derived and/or modified sequence opt5 from hemagglutinin__InfluenzaA__ABB04349
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacagcuuuuucucccgccugaauuggcucuauaagagcgagucuaaauacccugugcugaacguuaccaugcccaauaacggcaaguuugacaaacuuuauaucuggggagugcaccauccuuccacagauaaggagcaaaccaaucuguacgucagagccagcgggaaagugacgguguccacaaagcggucucagcagaccgucauuccgaacaucggcagccgccccuggguuagagggcucuccagccggauuucuaucuacuggacaauugugaagccuggagacauccugcugaucaacuccaccggcaaucucauugcgccccgcggcuauuucaaaaucagaaccgggaagucuucuauuaugcggagcgaugccccuaucggaacauguaacuccgaaugcauuacgcccaauggcucuaucccgaacgacaaaccuuuucagaaugugaacaagaucaccuacggggcuuguccccgcuaugucaaacaaaauacacugaaacuugccaccggaaugagaaacgugccugagaaacagacacggggcauuuucggggcuaucgccggauuuauugaaaauggcugggagggcaugguugacgggugguacggauuccgccaccagaacagcgagggcaccgggcaggcggccgaucugaaguccacgcaagcugccaucgaccagauuaauggaaagcucaacagacugaucgaaaagacaaaugagaaguuccaccagaucgaaaaagaguuuagcgaaguggagggccggauucaagaucuugagaaguaugucgaagacaccaaaaucgaucuguggucuuacaacgcugagcuccugguggcccuggaaaaucagcauaccauugaccucacagauuccgagaugaacaagcuguucgaaaagaccagaaaacagcuucgcgagaacgccgaggacauggggaauggcugcuuuaagaucuaucacaaaugugauaacgcuugcauuggaagcauccggaauggcacauacgaccaugauguuuacagagacgaagcgcugaacaaucgcuuccagauuaaggggguggagcucaaaucuggauauaaggacuggauccuguggaucuccuuugccauuagcugcuuccuucugugugucgugcuccugggcuuuaucaugugggcuugccaaaaggggaacauucgguguaauaucugcauuuga

SEQ ID NO: 183426 - RNA, 1701 nt, Artificial Sequence
  derived and/or modified sequence opt5 from hemagglutinin__InfluenzaA__ABB04360
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacaagagcgaguacaaauauccugcccugaacgugaccaugcccaauaacggaaaguucgauaaacuuuacaucuggggcguucaucacccuucuacagacagagagcaaaccaaucuguacgugcgggcguccgggcgcgucacggugagcacaaagagaucccagcagaccgugauuccgaacaucggaucucggcccuggguccgcggccucagcuccagaauuagcaucuauuggacaauuguuaaaccuggggauauccugcugaucaacucuaccggaaaucucauugcuccccggggcuacuuuaagauccgcaccggcaaguccagcauuaugagaucugacgccccuaucgggacauguagcuccgaaugcauuacgcccaacggaucuaucccgaaugacaaaccuuuccagaacgugaauaagaucaccuauggcgccuguccccgguacgugaaacaaaacacacugaaacuugcuaccgggaugcgcaaugucccugagaaacagacaagaggaauuuuuggcgccaucgcgggguucauugaaaacggaugggagggcaugguggauggcugguauggguuucggcaccagaauagcgagggaaccggccaggccgcugaccugaaguccacgcaagccgcuaucgaucagauuaacgggaaacucaauagacugaucgaaaagacaaacgagaaguuccaucagaucgaaaaagaguucagcgaaguugagggacgcauucaagaccuugagaaguacguggaagauaccaaaaucgaccuguggucuuauaaugccgagcuccuggucgcccuggaaaaccagcacaccauugaucucacagacuccgagaugaauaagcuguuugaaaagacccggaagcagcuuagagagaacgcugaggauaugggcaacgggugcuucaagaucuaccauaaaugugacaaugcgugcauuggcagcauccgcaacggaacauacgaucacgacguguaucgggacgaagcccugaauaacagauuucagauuaagggcguugagcucaaaucuggguacaaggauuggauccuguggaucuccuucgcuauuagcugcuuucuucugugugugguccuccugggauucaucaugugggccugccaaaaaggcaauauucgcuguaacaucugcauuuga

SEQ ID NO: 183427 - RNA, 1701 nt, Artificial Sequence
  derived and/or modified sequence opt5 from hemagglutinin__InfluenzaA__ABB04371
augaagaccaucauugcccugagcuacaucuucuaucucgcucugggccaggaccuucccgggaacgauaauuccaaagccacacugugccucggacaccaugcggugccuaacggcacgcuggucaagaccauuacagacgaucaaaccgagguuacaaaugcuaccgaacuugugcagucuagcuccacagggaaaaucuguaacaauccgcaccggauucuggacggaauggauugcacccucaucgacgcccugcugggcgauccccauugugacguguuucagaacgagacgugggaucucuucgucgaaagaucuaaggccuuuagcaauugcuacccuuaugacgugcccgauuacgcuucccugcgcucucuuguugccagcuccgggaccauggaguucaucacagaaggauuuaccuggacagaggugacccagaacggcggcagcaaugcuuguaaaagagggccugacucuggauucuuuucccggcugaacuggcucacgaaaagcggccgcacauaucccguccugaaugugaccaugccuaacaaugauaacuucgacaagcuguacauuuggggaguucaccauccgucuacagaccaagagcagaccaaucuguaugugcagaccuccgggagagucacagugagcacgcggcgcucucagcaaaccaucauucccaacaucggcuccagaccuugggugcgggggcucagcucccgcauuucuaucuacuggacaauugucaaacccggagauguucuggugaucaacagcaauggcaaccugaucgccccuagaggcuacuuuaagaugcggaccgggaaauccagcauuaugcgcucugacgcgcccaucgauacaugcauuuccgaauguaucaccccgaauggaagcauuccuaacgacaagcccuuccagaaugugaacaaaaucacguauggcgccugcccuaaguacgucaagcagaauacacucaaacuggcuaccgggaugagaaacgugcccgagaagcagacccggggacuuuuuggcgccaucgcuggguucauugaaaauggaugggagggcaugaucgauggcugguauggguuucgccaccaaaacucugagggaacaggccaggccgcggaccugaaaagcacccaggccgcuauugaucaaaucaaugggaagcucaacagaauuaucgaaaagacaaaugagaaguuccaccagaucgaaaaagaguucuccgaaguugagggacggauucaggaccuggagaaguacguggaagauacgaagaucgaccuuuggucuuauaacgccgagcugcucgucgcucuggaaaaucagcauaccauugaucugacagacagcgagaugaacaaacucuuugaaaagaccagacgccaacugcgggagaacgccgaggacaugggcaauggguguuucaaaaucuaccacaagugcgauaacgccuguauugaauccaucagaaauggcacauaugaccaugauguguaccgcgacgaggcucuuaacaaucgguuucagauuaaaggaguugaacuuaagagcggcuacaaggauuggauccucuggaucucuuucgcgauuuccugcuuucugcuuugcgugguccugcucggguucaucaugugggccugucagagaggaaacauucgcugcaauaucuguauuuga

SEQ ID NO: 183428 - RNA, 1701 nt, Artificial Sequence
  derived and/or modified sequence opt5 from hemagglutinin__InfluenzaA__ABB04906
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagaacggcgauucuuaugccugcaagcggggcuccgucaagagcuuuuucucucgccucaauuggcugcacaaauccgaguacaaguauccugcgcuuaacgugacaaugcccaauaacgacaaauuugauaagcuguacaucuggggaguucaucacccuagcaccgacagagagcaaacaucucucuacauucgggccuccgggaaagugaccgucagcacgaagcgcucccagcagacagugaucccgaauauuggcucuagacccugggugcgggggcugagcucccgcaucagcauuuauuggaccaucgucaagccuggagacauccugcucauuaacucuacaggcaaccugaucgcucccagaggguacuucaaaauucggaccggaaaguccagcaucaugcgcucugaugccccuauuggcaccuguagcuccgaaugcaucacacccaauggcucuaucccgaacgacaaaccuuuucagaauguuaacagaauuacguauggggcuuguccccgguacgugaagcaaaauacccuuaaacuggccacaggaaugcgcaacgugccugagaagcagaccagaggcaucuucggggcgauugccggauuuaucgaaaauggcugggaggggauggucgauggaugguauggcuuccggcaccagaacagcgagggcacagggcaggcugccgaccucaaauccacccaagcugccauugaucagaucaauggaaagcugaacagacuuaucgaaaagacgaaugagaaauuucaucagauugaaaaggaguucagcgaaguggagggccgcauccaagaccuggagaaauacguugaagauacaaagauugaccucuggucuuauaacgccgagcugcugguggcucucgaaaaucagcacaccaucgaucugaccgacuccgagaugaacaaacuuuucgaaaagacacggaagcagcugagagagaaugcggaggauauggggaacggaugcuuuaaaauuuaccauaagugugacaacgccugcaucggcagcauucgcaaugggaccuacgaccacgaugucuaucgggacgaagcucucaacaauagauuccagaucaaaggcguggagcugaagucuggauacaaagauuggauccuuuggauuuccuuugccaucagcugcuuccugcucuguguugugcugcugggcuuuauuaugugggccugccaaaaggggaacauccgcuguaauauuugcaucuga

SEQ ID NO: 183429 - RNA, 1701 nt, Artificial Sequence
  derived and/or modified sequence opt5 from hemagglutinin__InfluenzaA__ABB04917
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagauuucuagcacaggcagaaucugcgacuccccgcaccggauccuugaugggaaaaauuguacccugauugacgcccuccugggagauccccauugcgacggcuuccagaacgagaagugggaucuguuugucgaacgcucuaaagccuucagcaauuguuauccuuacgacgugcccgauuaugcuucccucagaucucugguugccagcuccgggacgcuugaguuuaucaacgaaggauucaauuggaccggcgugacacagagcggcgggucuuauaccugcaagcggggauccgucaacagcuuuuucucucgccugaauuggcucuacgaguccgagagcaaguacccugugcugaacguuacaaugcccaauaacggcaaauuugacaaacuuuauauuuggggagugcaccauccuucuaccgauaaggaacaaacgaaucuguacgucagagcuuccgggcgggugacagugagcaccaagcgcucccagcagacagucaucccgaacauuggcucuagacccuggguucgggggcucagcucccgcaucagcauuuacuggaccaucgugaaaccuggagacauccugcugauuaacucuaccggcaaucucaucgcccccagaggcuauuucaagauucggacagggaaguccagcaucaugcgcucugaugcgccuauuggaacguguagcuccgagugcaucacccccaacggcucuaucccgaaugacaaaccuuuucagaacgugaauaagauuacauacggggccugucccagauaugucaaacaaaacacccugaaacuugcuacaggaaugcggaaugugccugaaaagcagacccgcggcaucuucggggccauugcuggauuuaucgagaacggcugggagggcaugguugacgggugguacggauucagacaccagaauagcgaaggcacggggcaggccgcggaucugaaguccacacaagccgcuauugaccagaucaacggaaaacucaaucggcugaucgagaagaccaacgaaaaguuccaccagauugagaaagaauuuagcgagguggagggcagaauccaagaucuugaaaaguaugucgaggacaccaaaauugaucuguggucuuacaaugccgaacuccugguggcucuggagaaccagcauacaaucgaccucaccgauuccgaaaugaauaagcuguucgagaaaacacgcaagcagcuucgggagaacgccgaagacauggggaacggcugcuuuaagauuuaucacaaaugugauaaugccugcaucggaagcauuagaaacggcacguacgaccaugauguuuaccgcgacgaggcucugaauaaccgguuccagaucaaggggguggaacucaaaucuggauauaaggacuggauccuguggauuuccuuugcgaucagcugcuuccuucugugugucgugcuccugggcuuuauuaugugggccugccaaaaagggaauaucagauguaacauuugcaucuga

SEQ ID NO: 183430 - RNA, 1701 nt, Artificial Sequence
  derived and/or modified sequence opt5 from hemagglutinin__InfluenzaA__ABB04928
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcaauaacccgcacagaauccuugaugggaucaauuguacccugauugacgcccuccugggagauccccauugcgacggcuuccagaacgagaaaugggaucuguuugucgaacggucuaaggccuucagcaauuguuauccuuacgacgugcccgauuaugcuucccuccgcucucugguugccagcuccgggacgcuugaguuuaucaacgaaggauucaauuggauuggcgugacccagaacggcgggagcaaugcuugcaaaagaggaacagacucuggcuuuuucucccggcugaacuggcucuacaagagcgggucuaccuauccuguccaaaaugugacaaugcccaacaacgauaauuccgacaagcuguacaucuggggaguucaccauccuagcaccgauaaagagcagacggaccuuuaugugcaggccucuggcaaggucacaguguccaccaaacgcagccagcaaacaauuaucccgaacgugggguccagacccuggguccggggacugucuagccgcauuuccaucuacuggaccaucguuaagccuggcgacauucucgugaucaauagcaacggcaaucugauugcgcccagaggguacuuuaaaaugcggaccggaaagucuuccaucaugcgcagcgaugccccuauuggcacauguucuagcgagugcaucacgcccaacggguccaucccgaaugacaagccuuuccagaacgugaauaaaauuaccuauggagcuugucccaaguacgucaaacagaacacacugaagcucgccaccggcaugagaaaugugccugaaaaacagacacgggggaucuuuggagcuauugccggcuucaucgagaacggcugggaagggaugauugauggaugguauggcuuucgccaccaaaauucugaggggaccggacaggcggccgaccuuaagagcacgcaggcugccaucgaucaaaucaacggcaaacugaauagaguuauugagaagacaaacgaaaaguuccaccagaucgagaaagaguucuccgaaguggaagggcggauucaggaccuggagaaguacgucgaggauaccaaaaucgaccucuggagcuauaacgcugaacugcuuguggcccuggagaaucagcauaccauugaucucacagacucugaaaugaacaagcuguuugagaaaacccgcagacaacugcgggaaaaugccgaggauaugggcaacggaugcuucaagaucuaccacaagugugacaaugcuugcauuggcuccaucagaaacgggacauaugaccaugauguuuaccgcgacgaggcgcucaauaaccgguuucagaucaaaggaguggaacuuaagagcggcuacaaagauuggauucuguggaucucuuucgccauuuccugcuuucugcucugugucgugcugcuuggguucaucaugugggcuugccagaagggaaauauuagauguaacaucugcaucuga

SEQ ID NO: 183431 - RNA, 1701 nt, Artificial Sequence
  derived and/or modified sequence opt5 from hemagglutinin__InfluenzaA__ABB04939
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuauaccugcaagcggggaagcgucaacagcuuuuucucccgccugaauuggcucuacgagagcgagucuaaguacccugugcugaacguuacaaugcccaauaacggcaaauuugacaagcuguauaucuggggagugcaccauccuuccaccgauaaagaacaaacgaaucuguacgucagagcuagcgggcgggugacaguguccaccaagcgcucucagcagacagucauuccgaacaucggcagcagacccuggguucgggggcucuccagccgcauuucuaucuacuggaccauugugaaaccuggagacauccugcugaucaacuccauuggcaaucucaucgcccccagaggcuauuucaagauucggaccgggaagucuucuaucaugcgcagcgaugcgccuauuggaaucuguuccucugagugcaucacacccaacggcagcauuccgaaugacaaaccuuuucagaacgugaauaagaucacguacggggccugucccagauaugucaaacaaaacacccugaaacuugcuacaggaaugcggaaugugccugaaaagcagacccgcggcauuuucggggccaucgcuggauuuauugagaacggcugggagggcaugguugacgggugguacggauucagacaccaaaauuccgaaggcacagggcaggccgcggaucuuaagagcacccaggccgcuguggaccagaucaacggaaaacucaaucggcugaucgagaagacgaacgaaaaguuccaccagauugagaaagaauuuucugaggucgagggcagaauccaagaucuugaaaaguauguggaggacacaaaaauugaucugugguccuacaaugccgaacuccugguugcucuggagaaccagcauaccaucgaccucaccgauagcgaaaugaauaagcuguucgagaaaacacgcaagcagcuucgggagaacgccgaagacauggggaacggcugcuuuaagauuuaucacaaaugugauaaugccugcaucggaucuauuagaaacggcaccuacgaccaugauguguaccgcgacgaggcucugaauaaccgguuccagaucaagggggucgaacucaaauccggauauaaggacuggauccuguggauuagcuuugcgaucuccugcuuccuucugugugugguccuccugggcuuuauuaugugggccugccaaaaagggaauaucagauguaacauuugcaucuga

SEQ ID NO: 183432 - RNA, 1701 nt, Artificial Sequence
  derived and/or modified sequence opt5 from hemagglutinin__InfluenzaA__ABB04950
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuauaccugcaagcggggaagcgucaacuccuuuuucucucgccugaauuggcucuacgagagcgagucuaaguacccugugcugaacguuacaaugcccaauaacggcaaauuugacaaacuuuauaucuggggagugcaccauccuuccaccgauaaggaacaaacgaaucuguacgucagagcuagcgggaaggugacaguguccaccaaacggucucagcagacagucauuccgaacaucggcagccgccccuggguuagagggcucuccagccggauuucuaucuacuggaccauugugaagccuggagacauccugcugaucaacuccaccggcaaucucauugcgccccgcggcuauuucaagaucagaacagggaaaagcucuauuaugcggagcgaugccccuaucggaacguguuccucugagugcauuacccccaacggcagcaucccgaaugacaagccuuuucagaacgugaauaaaaucacauacggggccuguccccgcuaugucaagcaaaacacccugaaacuugcuacaggaaugagaaaugugccugaaaagcagacccggggcauuuucggggccaucgcuggauuuauugagaacggcugggagggcaugguugacgggugguacggauuccgccaccaaaauuccgaaggcacggggcaggccgcggaucugaaaagcacacaggccgcuaucgaccagauuaacggaaagcucaauagacugaucgagaagaccaacgaaaaauuccaccagaucgagaaggaauuuucugagguggagggccggauucaagaucuugaaaaauaugucgaggacaccaagaucgaucugugguccuacaaugccgaacuccugguggcucuggagaaccagcauacaauugaccucaccgauagcgaaaugaauaaacuguucgagaagacaagaaagcagcuucgcgagaacgccgaagacauggggaacggcugcuuuaaaaucuaucacaagugugauaaugccugcauuggaucuauccggaacggcacguacgaccaugauguuuacagagacgaggcucugaauaaccgcuuccagauuaaagggguggaacucaaguccggauauaaagacuggauccuguggaucagcuuugcgauuuccugcuuccuucugugugucgugcuccugggcuuuaucaugugggccugccaaaaggggaauauucgguguaacaucugcauuuga

SEQ ID NO: 183433 - RNA, 1701 nt, Artificial Sequence
  derived and/or modified sequence opt5 from hemagglutinin__InfluenzaA__ABB04983
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacagacagaauuugcgauucuccgcaccagauccuggacggcgagaauuguacccucaucgaugcccugcugggggacccccauugcgauggauuucagaacaaagaaugggaccucuucgucgagcggagcaaggccuauuccaauuguuacccuuaugaugugcccgacuacguuucucugcgcagccuuguggcuuccagcggcacgcuggaauuuaacaaugagucuuucaacuggaccggggucgcccaaaauggaacauccagcgcuugcaaaagacggucugauaaguccuuuuucagccgccucaacuggcugcaccagcuuaaguauaaauacccugcccugaaugugaccaugcccaacaaugagaaguuugacaaacucuauauuuggggcguucaucacccuggcacagauucugaccagaucucccuguacgcgcaggccagcgggagagugaccgucuccacgaagcggucucaacagacagugauuccgaacaucggaagccgccccugggugagaggcgucuccagccggauuucuaucuacuggaccauuguuaaaccuggggacauccugcucaucaacuccacaggaaaucugauugcuccccgcggcuauuucaagaucagaagcgggaagucuagcauuaugcgguccgaugccccuaucggaaaauguaacucugaaugcauuacccccaauggcagcaucccgaacgacaagccuuuucagaaugugaaccgcaucaccuacggccccuguccuagauaugugaaacagaauacacuuaagcuggcuacggggaugcggaacguccccgagaaacaaacccgcggaauuuucggcgccaucgcgggguuuauugaaaauggaugggagggcaugauggaugggugguacggauucagacaccagaacuccgagggcacaggccaggccgcugaccucaagagcacccaagccgcuaucaaucagauuaacgggaaacugaaucggcuuaucgaaaagacaaacgagaaguuucaucagaucgaaaaagaguucucugaaguggagggacgcauucaggaucuggagaaguauguugaagacaccaaaaucgaucucugguccuacaaugccgagcugcugguggcccucgaaaaccaacacacgauugaccugacagauagcgagaugaacaaacuuuucgaaagaaccaagaagcagcugcgggagaaugcugaggacaugggcaacgggugcuuuaagaucuaucauaaaugugauaaugcgugcauuggaucuaucagaaacggcaccuacgaccacgacgucuaccgcgaugaagcccucaauaaccgguuccagauuaaggggguggagcugaaauccggcuauaaggacuggauccuuuggaucagcuuugcuauuuccugcuuccugcucuguaucguucugcugggauuuauuaugugggccugccagaaaggcaauaucagauguaacauuugcaucuga

SEQ ID NO: 183434 - RNA, 1701 nt, Artificial Sequence; identical to SEQ ID NO: 183196
  derived and/or modified sequence opt5 from hemagglutinin__InfluenzaA__ABB04994

SEQ ID NO: 183435 - RNA, 1701 nt, Artificial Sequence
  derived and/or modified sequence opt5 from hemagglutinin__InfluenzaA__ABB05005
augaagaccaucauugcccugagccacauccucugccugguguucgcucagaaacuucccgucaacgacaauuccacagccacgcugugucucggccaucacgcgguuccuaacgggacccuggugaagacaauuaccaaugaucauaucgaggugacaaacgcuaccgaacuuguccaaucuagcuccacaggaagaauuugcgacucuccgcaccagauccuggauggcgagaauuguacccucaucgacgcccugcugggggauccccauugcgacggauuucagaacaaagaaugggaucucuucguggagcggagcacggccuacuccaauuguuauccuuacgacguucccgauuaugcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaccaacuuaaguacaaguauccugcgcugaaugugacaaugcccaacaaugagaaauuugacaagcucuacaucuggggcguucaccauccuucuaccgauuccgaccagauuagccuguaugcccaggcuuccggcagagugacggucucuacaaaacggagccagcaaaccgugaucccggauauugggucccgccccugggugagaggagucagcucucggaucuccauuuacuggacaaucguuaagccuggcgacauccugcucauuaacagcaccgggaaccugaucgcccccagaggauacuucaaaauuagaucuggcaagagcuccaucaugcggucuaaugcuccuauugggaaguguaacagcgaaugcaucacccccaauggauccgugccgaacgacaaaccuuuucagaaugugaaccgcaucacauauggcgccugucccagauacgucaagcagaauacgcuuaaacuggcgaccggcaugcggaacgugccugagaagcagacacgcgggauuuucggagccaucgcuggcuuuauugaaaaugggugggagggaaugguugauggcugguauggguucagacaccaaaacagcgagggaaccggccaggccgcugaccucaaaucuacacaggccgccaucaaucaaauuaacggcaagcugaaucggcuuaucgagaaaaccaacgaaaaguuucaucagaucgaaaaggaguucuccgaaguggaggggcgcauucaggaucuggagaaauacgucgaagacacgaagaucgaucucuggagcuauaaugcugagcugcugguggcgcucgaaaaccagcacacaauugaccugaccgauucugagaugaacaaacuuuucgaacgcacccggaagcaacugagagagaaugccgaggacaugggaaacggcugcuuuaaaaucuaccacaagugugauaaugcuugcauuggguccauccgcaacggaacauaugaccaugauguuuaccgggacgaagcccucaauaacagauuccagauuaagggcguggagcugaaaagcggguacaaggacuggauccuuuggaucuccuuugccauuucuugcuuccugcucugugucgugcugcugggcuuuaucaugugggcuugccagaaaggaaauauucgcuguaacaucugcauuuga

SEQ ID NO: 183436 - RNA, 1701 nt, Artificial Sequence
  derived and/or modified sequence opt5 from hemagglutinin__InfluenzaA__ABB05183
augaagaccaucauugcccugagcuacauccucugccugguguucgcucagaaacuucccgucaacgacaauuccacagccacgcugugucucggccaccaugcgguuccuaacgggacccuggugaagacaauuaccaaugagcacaucgaagugacaaacgcuaccgagcuuguccaaucuagcuccacaggaagaauuugcgauucuccgcaucagauccuggacggcgaaaauuguacccucaucgaugcccugcugggggacccccacugcgauggauuucagaacaaagagugggaccucuucguggaacggagcacggccuauuccaauuguuacccuuaugauguucccgacuacgcuucucugcgcagccuuguggccuccagcggcacccuggaguuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugaaaaauuugauaagcucuauaucuggggcguucaccacccuucuaccgacuccgaucagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgacauccugcucauuaacagcaccgggaaucugaucgcuccccgcggauauuucaaaauuagaucuggcaagagcuccaucaugcggucuaacgccccuauugggaaguguaauagcgagugcaucacccccaacggauccaucccgaaugauaaaccuuuucagaacgugaaucgcauuacauacggcgccugucccagauaugugaagcagaacacgcuuaaacuggcgaccggcaugcggaaugucccugaaaagcagacacgcgggaucuucggagccauugcuggcuuuaucgagaacgggugggagggaaugguggacggcugguacggguucagacaucaaaauagcgaaggaaccggccaggccgcugaccucaaaucuacacaggccgccauuaaccaaaucaauggcaagcugaaccggcuuaucgagaaaaccaaugaaaaguuucaccagauugagaaggaguucuccgaaguugaggggagaauccaggaucuggaaaaauauguggaggacacgaagauugaucucuggagcuacaacgcugaacugcuggucgcgcucgagaaccagcauacaaucgaccugaccgauucugaaaugaauaaacuuuucgagcgcacccggaagcaacugagagagaacgccgaagacaugggaaauggcugcuuuaaaguguaucacaagugugauaacgcuugcauuggguccauccgcaauggaacauacgaccacgauguuuaccgggacgaggcccucaacaauagauuccagauuaagggcguggaacugaaaagcggguauaaggauuggauccuuuggaucuccuuugccauuucuugcuuccugcucugugucgugcugcugggcuuuaucaugugggcuugccagaaaggaaacauucgcuguaauaucugcauuuga

SEQ ID NO: 183437 - RNA, 1701 nt, Artificial Sequence
  derived and/or modified sequence opt5 from hemagglutinin__InfluenzaA__ABB05194
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucauuaugcccaauaacgagaaguuugacaaacucuauaucuggggcgugcaucacccuucuaccgauuccgaccagauuagccuguacgcccaggcuuccgggagaguuacagugucuaccaagcggagccaacagacggucaucccgaacauuggaucccgccccugggugagaggcgugagcucucggaucuccauuuacuggacaaucgucaaaccuggggauauccugcucauuaauagcaccggaaaccugaucgcccccagaggcuauuucaagauuagaucugggaagucuuccguuaugcggucugacgcuagcaucggaaaauguaauuccgaaugcauuacaccuaacggcagcauccccaaugacaagccguuucagaacgugaaucgcaucaccuacggcgccuguccuagauaugugaaacagaacacccuuaagcuggcgacagggaugcggaauguccccgagaaacaaacgcgcggaauuuucggcgccaucgcuggguuuauugaaaacggaugggagggcaugguggaugggugguacggauucagacaccagaauagcgagggcaccggccaggccgcugaccucaaguccacacaagccgccaucaaccagauuaaugggaaacugaaccggcuuaucgaaaagaccaaugagaaguuucaucagaucgaaaaagaguucagcgaaguugagggacgcauucagaaccuggagaaguauguggaagauacaaaaaucgaccucuggucuuacaacgcugagcugcuggucgcgcucgaaaaucaacacaccauugaucugacggacuccgagaugaacaaacuuuucgaacgcacaaagaagcagcugcgggagaaugccgaggauaugggcaacgggugcuuuaagaucuaucauaaaugugacaaugcuugcauuggaagcaucagaaacggcaccuacgaucacgacguguaccgcgaugaagcccucaauaaccgguuccagauuaaggggguugagcugaaauccggcuauaaggacuggauccuuuggaucucuuuugccauuagcugcuuccugcucugugugguccugcugggauuuaucaugugggcuugccagaaaggcaauauuagauguaacaucugcauuuga

SEQ ID NO: 183438 - RNA, 1701 nt, Artificial Sequence
  derived and/or modified sequence opt5 from hemagglutinin__InfluenzaA__ABB05205
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaugccuauuccaacuguuacccuuaugacgugcccgauuacgcuucucugcgcagccuuguugccuccagcgggacgcuggaauuuaauucugaguccuucaacuggaccggaguggcucaaaauggcacaagcucugccugcaagagacgguccaacaagagcuuuuucucucgccucaauuggcugcaccagcuuaaguauaaguacccugcgcugaacgucaccaugcccaauaacgagaaauuugacaagcucuauauuuggggcgugcaucacccugggacagauuccgaccagaucagccuguacgcccaggcuuccggaagaguuaccgugucuacgaaacggagccaacagacagucauuccgaacaucggcucccgccccugggugagaggggugagcucucggauuuccaucuacuggaccauugucaagccuggagauauccugcucaucaauagcacaggcaaccugauugcccccagaggguauuucaaaaucagaucuggaaagagcuccauuaugcggucugacgcuccuaucggcaaguguaauagcgaaugcauuacccccaacggcuccaucccgaauaacaaaccuuuucagaauguuaaccgcaucaccuacggggccugucccagauaugugaagcagaauacacuuaaacuggcgacgggaaugcggaacgugccugagaagcaaacccgcggcauuuucggggccaucgcuggauuuauugaaaauggcugggaggggauggucgacggaugguacggcuucagacaccagaacagcgagggcacagggcaggccgcugaucucaaaucuacccaagccgccaucaaucagauuaacggaaagcugaaucggcuuaucgagaaaacaaacgaaaaguuucaucagaucgaaaaggaguucuccgaaguggagggccgcauucaggaccuggagaaauauguugaagauaccaagaucgaccucuggagcuacaacgcugagcugcugguggcgcucgaaaaucaacacacgauugaucugacagacucugagaugaacaaacuuuucgaacgcaccaagaaacagcugcgggagaaugccgaggauauggggaacggaugcuuuaagaucuaucauaagugugacaaugcuugcauuggcuccaucagaaacgggaccuacgaucacgacgucuaccgcgaugaagcccucaauaaccgguuccagauuaaaggcguggagcugaaaagcggauauaaagacuggauccuuuggaucuccuuugccauuucuugcuuccugcucuguguugugcugcugggcuuuaucaugugggcuugccagaaggggaauauuagauguaacaucugcauuuga

SEQ ID NO: 183439 - RNA, 1701 nt, Artificial Sequence; identical to SEQ ID NO: 183096
  derived and/or modified sequence opt5 from hemagglutinin__InfluenzaA__ABB05216

SEQ ID NO: 183440 - RNA, 1701 nt, Artificial Sequence
  derived and/or modified sequence opt5 from hemagglutinin__InfluenzaA__ABB46392
augaagaccaucauugcccugagcuacaucuucugccucgcuuuugcccaggaccugcccggcaacgauaauuccacagcgacgcuuugucuggggcaccaugcugugccuaacggaacccucgucaaaacaauuaccaaugaccaaaucgagguuacaaacgccaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuuguggaacggucuaaggcuuucagcaacuguuauccuuacgauguccccgacuaugccucccuccgcucucugguggcuagcuccgggacgcuugaguuuaucaaugaaggauucaacuggaccggcguuacacagaauggcgggagcucugccugcaaaagaggaccugauaacggcuuuuucucccggcugaauuggcucuacaagagcgggucuaccuaucccgugcaaaacgucacaaugccuaauaacgacaacuccgauaagcuguacauuuggggagugcaccauccgaauaccgacaaagagcagacggaccuuuauguucaggcgagcggcaaggugacagucucuaccaaacgcucccagcaaacaaucauucccaacguggggagcagaccuugggugcggggacuguccucucgcgucagcaucuacuggaccauuguuaagcccggcgauauccucgugaucaauuccaacggcaaucugauugccccuagaggguacuuuaaaaugcggaccggaaagagcucuaucaugcgcuccgacgcucccauuggcacauguagcucugagugcaucacgccgaacgggagcauuccuaaugauaagcccuuccagaacgugaauaaaaucaccuauggagccuguccuaaguacgucaaacagaacacacugaagcucgcuaccggcaugagaaaugugcccgaaaaacagacacgggggaucuuuggagccauugcgggcuucaucgagaacggcugggaagggaugauugacggaugguauggcuuucgccaccaaaauuccgaggggaccggacaggccgcugaucugaagucuacgcagacagccaucgaccaaauuaacggcaaacuuaauagaguuaucgagaagaccaacgaaaaguuccaccagaucgagaaagaguucagcgaaguggaagggcggauucaggaucuggagaaguacgucgaggacaccaaaaucgaucucugguccuauaacgcugaacugcuuguggcccuggagaaucagcauacaauugaccucaccgauagcgaaaugaacaagcuguuugagaaaacacgcagacaacugcgggaaaaugccgaggacaugggcaacggaugcuucaagaucuaccacaagugugacaaugcuugcauuggcucuaucagaaacgggacguaugaucaugacguuuaccgcgaugaggcgcucaauaaccgguuucagauuaaaggaguggaacugaaguccggcuacaaagacuggauccuuuggaucagcuucgccauuucuugcuuucugcucugugucgugcugcuuggguucaucaugugggcuugccagaagggaaauauuagauguaacaucugcauuuga

SEQ ID NO: 183441 - RNA, 1701 nt, Artificial Sequence
  derived and/or modified sequence opt5 from hemagglutinin__InfluenzaA__ABB46414
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuuccgggcggguuacggugucuacaaagcgcagccagcaaaccgucauuccgaacaucggauccagacccugggugcggggcgugagcucucgcauuuccaucuacuggacaauugucaaaccuggggacauccugcucaucaacagcaccggaaaucugauugcccccagaggcuauuucaagauccggucuggaaagagcuccauuaugcgcucugacgcuccuaucgggaaauguaacagcgagugcauuacccccaauggcuccaucccgaacgauaagccuuuucagaauguuaacagaaucacauacggcgccuguccccgguaugugaaacagaauacgcuuaagcuggcgaccgggaugcgcaacgugccugaaaaacagacaagaggaauuuucggcgccaucgcuggguuuauugagaauggaugggaaggcauggucgacgggugguacggauuccggcaccaaaacagcgagggcaccggccaggccgcugaucucaagucuacacaggccgccaucaaucaaauuaacgggaaacugaauagacuuaucgagaagaccaacgaaaaguuucaucagaucgagaaagaguucuccgaaguggaaggacgcauucaggaccuggagaaguauguugaggauacgaaaaucgaccucuggagcuacaaugcugaacugcugguggcgcucgagaaccagcacacaauugaucugaccgacucugaaaugaacaagcuguucgagcggaccagaaaacaacugcgcgaaaaugccgaggauaugggcaacgggugcuuuaagaucuaucauaagugugacaaugcuugcauuggauccauccggaacggcacauacgaucacgacgucuacagagacgaggcccucaauaaccgcuuccagauuaaagggguggaacuuaagagcggcuauaaagauuggauccuuuggaucuccuuugccauuucuugcuuccuguuuuguguugugcuccugggauucaucaugugggcuugccagaagggcaauauucgguguaacaucugcauuuga

SEQ ID NO: 183442 - RNA, 1701 nt, Artificial Sequence
  derived and/or modified sequence opt5 from hemagglutinin__InfluenzaA__ABB46425
augaagaccaucauugcccugagcuacauccucugccugguguucgcucagaaacuucccggcaacgacaauuccacagccacgcugugucucgggcaccaugcggucccuaacggaacccugguuaagacaauuaccucugaucaaaucgaggugacaaaugcuaccgaacuugugcagagcuccucuacaggcaaaauuugcgacagcccgcacagaauccuggauggggagaacuguacccucaucgacgcccugcugggagauccccauugcgacggcuuucagaauaaggaaugggaucucuucgucgagcgguccaaagccuauucuaacuguuacccuuaugacgugcccgauuacgcuagccugcgcucccuuguugccagcucugggacgcuggaauuuaauaacgaguccuucaauuggaccggaguggcucagaacggcaccagcuuugccugcaagagacggucuauuaaguccuucuuuagccgccucaauuggcugcaccaacuuaaauauaaguacccugcgcugaacgucacaaugcccaauaacgacaaauucgauaagcucuauaucuggggcgugcaucacccuucuacagacuccgaucagaccagccuguacgcccaggcuuccgggagaguuacggugucuacaaaacggagccagcaaaccgucauuccgaauaucggaucccgccccugggugagaggcgugagcucucggauuuccaucuacuggacaauugucaagccuggggacauccugcucaucaacagcaccggaaaccugauugcccccagaggcuauuuuaagaucagaucugggaaaagcuccauuaugcggucugacgcuccuaucggaaaguguaauagcgagugcauuacccccaacggcuccaucccgaaugauaaaccuuuccagaacguuaaucgcaucacauacggcgccugucccagauaugugaagcagaacacgcuuaaacuggcgaccgggaugcggaaugugccugaaaagcagacacgcggaauuuuuggcgccaucgcuggguucauugagaacggaugggaaggcauggucgacgggugguacggauuuagacaccaaaauagcgagggcaccggccaggccgcugaucucaaaucuacacaggccgccaucaaccaaauuaaugggaagcugaaccggcuuaucgagaagaccaaugaaaaauuccaucagaucgagaaggaguucuccgaaguggaaggacgcauucaggaccuggagaaauauguugaggauacgaagaucgaccucuggagcuacaacgcugaacugcugguggcgcucgagaaucagcacacaauugaucugaccgacucugaaaugaacaaacuuuuugagcgcacccggaagcaacugagagaaaacgccgaggauaugggcaaugggugcuucaagaucuaucauaaaugugacaacgcuugcauuggauccauccgcaauggcacauacgaucacgacgucuaccgggacgaggcccucaacaauagauuucagauuaaggggguggaacugaaaagcggcuauaaggauuggauccuuuggaucuccuucgccauuucuugcuuucugcucuguguugugcugcugggauucaucaugugggcuugccagaaaggcaacauucgcuguaauaucugcauuuga

SEQ ID NO: 183443 - RNA, 1701 nt, Artificial Sequence
  derived and/or modified sequence opt5 from hemagglutinin__InfluenzaA__ABB46436
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguacgacaaacuguauaucuggggagugcaccauccugggacggauaaugaccagauuucucucuacgcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguauuucaagauuagaucuggaaaguccagcaucaugcggucugacgcccccaucggcaaauguaauagcgagugcauuacaccgaacggcuccaucccuaaugauaagcccuuucagaacgugaaucgcauuacguacggggcuuguccuagauaugucaaacagaacacccugaagcuggccacaggaaugcggaauguucccgaaaaacaaacccgcggcaucuucggggcgauugccggauuuaucgagaacggcugggaagggaugguggacggaugguacggcuucagacaccaaaauucugagggcaucgggcaggcugccgaucuuaagagcacacaggcugccauuaaccagaucaauggaaaacucaaccggcugauuggcaagaccaacgagaaguuucaccagaucgaaaaagaguucuccgaaguggaggggcgcauucaggaccuugaaaaguaugucgaggauacgaaaaucgaccuguggagcuacaaugccgagcuccugguggcucuggaaaaccaacauacaauugaucucaccgacucugagaugaauaagcuguucgaaagaaccaaaaagcagcuucgggagaacgcggaagauaugggaaauggcugcuuuaagaucuaucacaaaugugacaacgccugcaucggguccauuagaaauggcacauacgaucaugacguuuaccgcgacgaggcucugaacaaucgguuccagaucaagggaguggagcucaaaagcggcuauaaggauuggauucuguggaucucuuuugccauuuccugcuuccuucugugugucgcccuccugggguuuaucaugugggcuugccagaaaggaaacaucagauguaauauuugcaucuga

SEQ ID NO: 183444 - RNA, 1701 nt, Artificial Sequence; identical to SEQ ID NO: 183377
  derived and/or modified sequence opt5 from hemagglutinin__InfluenzaA__ABB46447

SEQ ID NO: 183445 - RNA, 1701 nt, Artificial Sequence
  derived and/or modified sequence opt5 from hemagglutinin__InfluenzaA__ABB46458
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaaaccaacagacagugauuccgaauaucgggucccggccccgcgucagagauauuccuucucggaucagcaucuacuggaccauugugaaacccggagacauccugcugauuaacuccaccggcaaucucaucgcuccucgcggguacuuuaagauuagaagcggaaagucuuccaucaugcggagcgacgcccccaucggcaaauguaagucugagugcauuacaccgaacggcagcaucccuaaugauaaacccuuccagaacgugaaucgcauuacguauggggcuuguccuagauacgucaagcagaacacccugaaacuugccacaggaaugcggaauguucccgaaaagcaaacccgcggcaucuuuggggcgauugccggauucaucgagaacggcugggaagggaugguggacggaugguauggcuuuagacaccaaaauuccgagggcaucgggcaggcugccgaucugaaaucuacacaggcugccauuaaccagaucaauggaaagcucaaccggcugauuggcaagaccaacgagaaauuccaccagaucgaaaaggaguucagcgaaguggaggggcgcauucaggaccuugaaaaauacgucgaggauacgaagaucgaccugugguccuauaaugccgagcuccugguggcucuggaaaaccaacauacaauugaucucaccgacagcgagaugaauaaacuguuugaaagaaccaagaagcagcuucgggagaacgcggaagauaugggaaauggcugcuucaaaaucuaccacaagugugacaacgccugcaucgggucuauuagaaauggcacauaugaucaugacguuuaccgcgacgaggcucugaacaaucgguuucagaucaaaggaguggagcucaaguccggcuacaaagauuggauucuguggaucagcuucgccauuucuugcuuucuucugugugucgcccuccugggguucaucauguggggaugccagaagggcaacaucagauguaauauuugcaucuga

SEQ ID NO: 183446 - RNA, 1701 nt, Artificial Sequence
  derived and/or modified sequence opt5 from hemagglutinin__InfluenzaA__ABB51961
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuuuuagcacaggcgggaucugcgacuccccgcaccagauccuugauggagagaauuguacccugauugacgcccuccugggcgauccccagugcgacggguuccaaaacaaaaagugggaucuguuugucgaaagaucuaaagccuauagcaauuguuacccuuaugacgugcccgauuacgcuugcguucggucccucguggccucuagcggaacgcuggaguucaacaaugaauccuuuaacugggcuggcgucacccagaauggcacaagcucugccuguaagcgcagauccaacaagagcuucuuuucucggcuuaauuggcugacccaucucaaauauaaguacccugcgcugaacgugacaaugcccaauaacgagaaauucgacaaacuuuauaucuggggaguucaccauccugggaccgauuccgaccagauuagccuguacgcccaggcuucuggccgcaucacgguguccacacaaagaugcaagcagcucgucauuccgaacaucgggagccggccccgcgugagagauguguccucucggauuagcaucuacuggaccaucgucaauccuggagacauucugcugaucaacuccacaggcaaucucauugcccccagaggguauuuuaagaucagaagcggaaagucuuccauuaugcggagcgacgcuccuaucggcaaauguaacucugagugcaucacccccaauggcagcauuccgaacgauaagccuuuccagaauguuaaccgcaucaccuacggggccugucccagauaugugaaacagaauacacugaaacuugcgacgggaaugcggaacgugccugaaaagcaaacccgcggcauuuuuggggccaucgcuggauucauugagaauggcugggaagggauggucgacggaugguacggcuuuagacaccagaacuccgagggcacagggcaggccgcugaucugaagucuacccaagccgccaucaaucagaucaacggaaaacucaaucggcugauuggcaagacaaacgagaaguuccaccagaucgaaaaagaguucagcgaaguggaggggcgcauucaggaccuugaaaaguauguugaggauaccaaaaucgaccugugguccuacaacgcugagcuccugguggcgcuggaaaaucaacauacgauugaucucacagacagcgagaugaacaagcuguuugaacgcaccaaaaagcagcuucgggagaaugccgaagauaugggaaacggcugcuucaagaucuaucacaaaugcgacaaugcuuguauugagucuaucagaaacgggaccuacgaucaugacgucuaccgcgacgaggcccugaauaaccgguuucagaucaagggcguggaacucaaauccggauauaaggauuggauucuguggaucagcuucgccauuucuugcuuucuucuguguguugcucuccugggcuucaucaugugggccugccagaaagggaauauuagauguaacaucugcaucuga

SEQ ID NO: 183447 - RNA, 1698 nt, Artificial Sequence
  derived and/or modified sequence opt5 from hemagglutinin__InfluenzaA__ABB51962
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcgaaugggaaccucauugccccuugguaugcuuucgccauguccagaggauuuggcagcggcaucucuaccuccaaugcucccaugggggagugugaugccaaguuccagacaccgcaaggaggcauuaacaucagccugccuuuucagaaugugcaccccgucaccaucggggaaugcccuaacuacgugcggucugcgaagcugcgcaugguuaccggacuuagaaauauucccagcauccagucccggggccucuucggggccauugcuggauuuaucgagggcggcuggacagggaugguggacggaugguauggcuaccaucaccagaacgaacaagggucuggauacgccgcugaucagaaaagcacgcagaaugccauuaacggcaucaccaauaaggucaacuccgugaucgagaaaaugaauacacaguucaccgccguugggaaggaguucaacaaacuggaacgcagaauggagaaccugaauaagaaaguggacgauggcuuucucgacauuuggacauauaacgcugaacugcuuguccugcucgagaaugaacggacccuggauuuccacgacagcaacgugaagaaucuuuacgagaaggucaaaucucaacugaagaacaaugcgaaagaaaucggaaacggcuguuccgaguuuuaucauaagugcaauaacgaguguauggaaagcgugaaaaaugggacguacgacuaucccaaguacucugaggaauccaagcucaaccgcgagaaaauugauggaguuaagcuggagagcaugggcguguaucagauccuggccauuuacuccacagucgcuucuagccucgugcugcuuguuucccugggggccaucucuuucuggaugugcagcaauggaucccuccagugcagaaucuguauuuga

SEQ ID NO: 183448 - RNA, 1701 nt, Artificial Sequence
  derived and/or modified sequence opt5 from hemagglutinin__InfluenzaA__ABB51963
augaagaccaucauugcccugagcuacauccucugccugguguucgcucagaaacuucccggcaacgacaauuccacagccacgcugugucucgggcaccaugcggucccuaacggaaccauuguuaagacaaucaccaaugauagaauugaggugacaaacgcuaccgaacuggugcaaucuagcuccacaggcgggaucugcgacucuccgcaccagauccuugauggagagaauuguacccugauugacgcccuccugggcgauccccagugcgacggguuucagaacaaaaagugggaucuguucgucgaacggagcaaagccuauuccaauuguuacccuuaugacgugcccgauuacgcuucucuccgcagccugguugccuccagcggaacgcuugaguuuaacaaugaaucuuucaacuggaccggcgugacacaaaauggcaccuccagcgcuugcaagagacggucuaacaauuccuuuuucagccgccugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggcagaaucacaguuagcaccaagcggucccagcaaacagugauuccgaacaucgggucucgccccagaguccggcacauuccuagccgcaucuccaucuacuggaccauugugaaucccggagauauccugcugauuaacagcaccggcaaucucaucgcuccuagaggguacuuuaaaauucggucuggaaaguccagcaucaugcgcucugacgcccccaucggcaaguguaacagcgagugcauuacaccgaauggcuccaucccuaacgacaaacccuuccagaaugugaacagaauuacguauggggcuuguccucgguacgucaagcagaauacccugaaacuugccacaggaaugcgcaacguucccgaaaagcagaauagaggcaucuuuggggcgauugccggauucaucgagaacggcugggaagggaugguggauggaugguauggcuuucggcaccaaaauucugagggcaucgggcaggcugccgaccugaaaagcacccaggcugccauuaaccaaaucaacgagaagcucaauagacugauuggaaaaacaaacgaaaaguuccaucagaucgagaaggaguucuccgaaguggaaggccgcauucaggaucuugagaaauacgucgaggacaccaagaucgaucuguggagcuauaaugccgaacuccugguggcucuggagaaccagcacacgauugaccucacagauucugaaaugaauaaacuguuugagcggaccaagaaacaacuuagagaaaacgcggaggacauggggaauggaugcuucaagguuuaccauaagugugauaacgccugcaucggcuccauccgcaaugggaccuaugaccacaacguguaccgggaugaggcucugaauaacagauuucagauuaaaggcgucgaacucaagagcggauacaaagacuggauccuguggauuucuuucgccaucuccugcuuucuucuguguguggcccuccugggcuucauuaugugggcuugccagaaggggaauauccgcuguaacaucugcauuuga

SEQ ID NO: 183449 - RNA, 1701 nt, Artificial Sequence; identical to SEQ ID NO: 183306
  derived and/or modified sequence opt5 from Hemagglutinin__InfluenzaA__ABB51964

SEQ ID NO: 183450 - RNA, 1698 nt, Artificial Sequence
  derived and/or modified sequence opt5 from hemagglutinin__InfluenzaA__ABB53603
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaaaagaaagaaguucugauucucuggggagugcaucacccuccgaacaucggcaaccagagaacccuguacuauacagagaaugcuuacgucagcgugguguccucucacuauagccggcgcuucacccccgaaauuacgaagagaccuaagguccgggaucaggaggggcgcaucaacuacuauuggacacuucuggaacccggagacaccauuaucuuugaggccaauggcaaccucauugcgccuugguacgccuucgcucuguccagaggguuuggaagcggcaucaucacaucuaaugcccccauggaugagugugacgcuaaaugccagaccccgcaaggcgccauuaacuccagccuuccuuuccagaauguucaucccgugaccaucggggaauguccuaaguaugugcggucugcgaaacugcgcauggucacaggacucagaaacauucccagcauccagucccggggccuguuuggggccauugcuggauucaucgagggcggguggacgggaaugguggauggcugguacggcuaccaccaucagaaugaacaagggucuggauaugccgcugaccaaaagagcacccagaacgccaucaauggcauuacaaacaaaguuaauuccgugaucgagaagaugaacacccaguuuacagccgucgggaaagaguucaauaagcuggaacgcagaauggagaaccucaacaagaaaguggaugacggauuccuggauauuuggaccuacaaugcugaacuucugguucuccuggagaacgaacggacgcuugacuuucacgacagcaaugugaagaaccuguaugagaaagucaagucucagcucaaaaauaacgcgaaggaaaucggcaaugggugcuucgaguuuuaccacaaguguaacaaugagugcauggaauccgugaaaaacggcacauaugauuaccccaaguauagcgaggaaucuaaacugaaucgcgagaagauugacggagucaaacuggauuccaugggcguguaccagauccucgccaucuacagcaccguugcuuccucucuggugcuucuggucagccucggggccauuuccuucuggaugugcucuaacggaagccugcaguguagaaucugcauuuga

SEQ ID NO: 183451 - RNA, 1701 nt, Artificial Sequence; identical to SEQ ID NO: 183279
  derived and/or modified sequence opt5 from hemagglutinin__InfluenzaA__ABB53614

SEQ ID NO: 183452 - RNA, 1701 nt, Artificial Sequence; identical to SEQ ID NO: 183279
  derived and/or modified sequence opt5 from hemagglutinin__InfluenzaA__ABB53625

SEQ ID NO: 183453 - RNA, 1701 nt, Artificial Sequence; identical to SEQ ID NO: 183306
  derived and/or modified sequence opt5 from hemagglutinin__InfluenzaA__ABB53652

SEQ ID NO: 183454 - RNA, 1701 nt, Artificial Sequence
  derived and/or modified sequence opt5 from hemagglutinin__InfluenzaA__ABB53663
augaagaccaucuucgcccugagcuacauucucugccugguguuugcucagaaacuucccggcaacgacaauuccacagccacgcugugucucgggcaccaugcggucccuaacggaaccaucguuaagacaauuaccaaugaucaaaucgaggugacaaacgcuaccgaacuggugcagucuagcuccacaggcgggauuugcgacucuccgcaccagauccuugauggagagaauuguacccugaucgacgcccuccugggcgauccccagugcgacggguuccaaaacaaaaagugggaucuguuugucgaaagaagcaaagcccauuccaauuguuauccuuacgacgugcccgauuaugcuucucuccggagccugguugccuccagcggaacgcuugaguucaacaaugaaucuuuuaacuggaccggcgugacacagaauggcaccuccagcgcuugcaagcgcagaucuaacaauuccuucuuuagccggcugaacuggcucacacaccugaaguucaaauacccugcccuuaaugucaccaugcccaacaacgagaauuuugacaagcuguauauuuggggagugcaucacccugggacggauaacgaccagaucucucucuacgcgcaggccuccggccgcauuacaguuagcaccaaaagaucccaacagacagugaucccgaauauugggucucggccccgcgucagagauaucccuagccggauuuccaucuauuggaccaucgugaagcccggagacauucugcugaucaacagcaccggcaaucucauugcuccucgcggguacuucaaaaucagaucuggaaaguccagcauuaugcggucugacgcccccaucggcaaguguaacagcgagugcaucacaccgaauggcuccauuccuaacgauaaacccuuucagaaugugaaccgcaucacguacggggcuuguccuagauaugucaagcagaauacccugaaacuugccacaggaaugcggaacguucccgaaaagcaaacccgcggcauuuucggggcgaucgccggauuuauugagaauggcugggaagggaugguggacggaugguacggcuucagacaccagaacucugagggcaucgggcaggcugccgaucugaaaagcacacaagcugccaucaaucagauuaacggaaagcucaaccggcugaucggcaaaaccaaugagaaguuccaucagauugaaaaggaguuuuccgaaguggaggggagaauccaggaccuugaaaaauaugucgaggauacgaagauugaccuguggagcuacaacgccgagcuccugguggcucuggaaaaucaacacacaaucgaucucaccgacucugagaugaacaaacuguucgaacgcaccaagaaacagcuucgggagaaugcggaagauaugggaaacggcugcuuuaagauuuaucauaagugugacaaugccugcaucggguccaucagaaacggcacauacgaucacgacguuuaucgcgacgaggcucugaauaaccgguuccagauuaaaggaguggagcucaagagcggcuacaaagauuggauccuguggauuucuuuugccaucuccugcuuccuucugugugucgcccuccugggguuuauuaugugggcuugccagaagggaaauaucagauguaacaucugcauuuga

SEQ ID NO: 183455 - RNA, 1701 nt, Artificial Sequence; identical to SEQ ID NO: 183279
  derived and/or modified sequence opt5 from hemagglutinin__InfluenzaA__ABB53685

SEQ ID NO: 183456 - RNA, 1701 nt, Artificial Sequence
  derived and/or modified sequence opt5 from hemagglutinin__InfluenzaA__ABB53696
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcauuggauccaucagaaauggcaccuacgaccacgaugucuaccgcgacgaagcccucaacaaucgguuccagauuaaggggguggagcugaaaagcggcuauaaggacuggauccuuuggaucuccuuugccauuucuugcuuccugcucuguaucgcucugcugggauuuauuaugugggccugccagaaaggcaacaucagauguaauguuugcauuuga

SEQ ID NO: 183457 - RNA, 1698 nt, Artificial Sequence; identical to SEQ ID NO: 183320
  derived and/or modified sequence opt5 from hemagglutinin__InfluenzaA__ABB53707

SEQ ID NO: 183458 - RNA, 1701 nt, Artificial Sequence; identical to SEQ ID NO: 183267
  derived and/or modified sequence opt5 from hemagglutinin__InfluenzaA__ABB53718

SEQ ID NO: 183459 - RNA, 1698 nt, Artificial Sequence
  derived and/or modified sequence opt5 from hemagglutinin__InfluenzaA__ABB53740
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaugggcgaucagagagcccuguaccacacagaaaacgcuuaugugagcgucguuuccucucauuacagccggcgcuucacccccgagaucgccaaaagaccuaaggugcgggaccaggaagggcgcauuaauuauuacuggacgcuucuggagcccggagagacaaucauuuuugaagcgaacggcaaucucaucgccccuagauaugcuuucgcccugucccggggguuuggaagcggcauuaucaccucuaacgcucccauggaugagugugacgccaagugccagacaccgcaaggcgcgauuaauuccagccuuccuuuccagaacgugcaccccgucaccaucggggaauguccuaaauacgugcgcucuaccaagcugagaaugguuacaggacuccggaauauccccagcauucagucccgcggccuguuuggggccaucgcuggauucauugagggcggguggacgggaaugguggauggcugguauggcuaccaucaccagaacgaacaagggucuggauacgccgcugaccagaaaagcacccagaaugccaucaacggcauuacaaauaaggucaacuccgugaucgagaaaaugaauacccaguuuacagccguugggaaggaguucaacaaacuggaaagacggauggagaaucucaacaagaagguggaugacggauuccuggauaucuggaccuauaacgcugaacuucugguccuccuggagaaugaacgcacgcuugacuuucacgacagcaacgugaaaaaucuguacgagaaggucaaaucucaacucaagaacaaugcgaaagagauuggcaacgggugcuucgaauuuuaucauaaguguaaugaugagugcauggaauccgugaagaacggcacauacgacuaucccaaauacagcgaggagucuaagcugaauagagagaaaaucgauggaguuaagcuggaauccaugggcguguaucagauucucgccaucuacagcaccgucgcuuccucucuggugcuucugguuagccucggggccauuuccuucuggaugugcucuaacggaagccugcagugucggaucugcaucuga

SEQ ID NO: 183460 - RNA, 1701 nt, Artificial Sequence
  derived and/or modified sequence opt5 from hemagglutinin__InfluenzaA__ABB53751
augaagaccaucauugcccugagcuacaucuccugccucguguucgcucagaaccugcccggcaaugacaacucuacagccacgcuuugucuggggcaccaugcggucccuaauggaacccucguuaaaacaauuaccaacgaucaaaucgaggugacaaaugcuaccgaacuggugcagagcuccucuacaggcagaauuugcgacagcccgcaccggauccuugaugggaagaacuguacccugaucgacgcccuccugggagauccccauugcgacggcuuucagaaugagaaaugggaucuguucgucgaacgcuccaaggccuuuucuaacuguuauccuuacgacgugcccgauuaugcuagccucagaucccugguugccagcucugggacgcuugaguucauuaaugaaggauuuaacuggaccggcgugacacaguccggcgggagcuacgcuugcaaacggggaucugacaauuccuucuuuagccgccugaacuggcucuauaagucugaguccaaguacccuguccugaaugugaccaugcccaacaauggcaacuucgauaaacuuuauaucuggggaguucaccauccuagcacagacaaggagcaaaccaaccuguacgugagagccuccgggcgggucacggugucuacaaaacgcagccagcagaccauuaucccgaauauuggcuccagacccugggugcgggggcucagcucuggaaucuccauuuacuggacaaucgucaagccuggcgauauccugcugauuaacagcaauggcaaccucaucgcgccccgcggguauuuuaaaauuagaaccggaaagucuagcauccugcgguccgacgccccuauuggcaccuguucuagcgaaugcaucacacccaauggguccaucccgaacgacaagccuuuccagaauguuaacaaaauuacguacggagcuugucccaaguaugugaaacaaaauacccuuaagcuggccacaggcaugcgcaacgugccugagaaacagaccagagggaucuuuggagcuauugccggcuucaucgaaaauggcugggaggggauggucgauggaugguacggcuuucggcaccagaacagcgaggggacaggacaggcggccgaccucaagucuacccaagcugccauugaucagaucaauggcaaacugaaccgcgugaucgaaaagacgaaugagaaguuccaccagauugaaaaagaguucuccgaaguugaggggagaauccaagaccuugagaaguauguggaagauacaaaaauugaccuguggagcuacaacgcugagcuccuggucgcccuggaaaaccagcauaccaucgaucucaccgacucugagaugaauaagcuguuugagaaaacacggagacagcuucgcgaaaacgccgaggauaugggcaauggaugcuucaagauuuaucacaagugugacaacgcuugcaucggcuccauucggaaugggaccuacgaucaugacguguacagagacgaagcgcugaacaaucgcuuucagaucaaaggaguugagcucaagagcggcuauaaagauuggauccuguggauuuccuucgccaucucuugcuuucuucugugugugguccuccugggguucauuaugugggcuugccaaaagggaaacauccgguguaauauuugcaucuga

SEQ ID NO: 183461 - RNA, 1701 nt, Artificial Sequence
  derived and/or modified sequence opt5 from hemagglutinin__InfluenzaA__ABB60007
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacagacagaauuugcgauucuccgcaccggauccuggacggcgagaauuguacccucaucgaugcccugcugggggacccccauugcgauggauuucagaacaaagaaugggaccucuucgucgagcgcagcaaggccuauuccaauuguuacccuuaugaugugcccgacuacgcuucucugagaagccuuguugccuccagcggcacgcuggaauuuaacaaugagucuuucaacuggaccgggguggcucagaauggaacauccuaugccugcaaacggcgcagcauuaagucuuucuucuccagacucaacuggcugcaccaacuuaaguacaaauauccugcgcugaaugucaccaugcccaacaaugauaaguuugacaaacucuacaucuggggcgugcaucacccuagcacagauucugaccagaccucccuguacgcccaggcuagcggccggguuacgguguccacaaagcgcucucagcaaaccgucauuccgaacaucgggagcagacccugggugcggggaguguccagccgcauuucuaucuauuggacaauugucaaaccuggcgacauccugcucaucaacuccaccgggaaucugauugcccccagaggauacuucaagauccggagcggcaagucuagcauuaugcgcuccgaugcuccuaucgggaaauguaacucugagugcauuacccccaauggaagcaucccgaacgacaagccuuuucagaauguuaacagaaucacauauggcgccuguccccgguacgugaaacagaauacgcuuaagcuggcgaccggcaugcgcaacgugccugaaaaacagacaagagggauuuucggagccaucgcuggcuuuauugagaaugggugggaaggaauggucgauggcugguauggguuccggcaccaaaacuccgagggaaccggccaggccgcugaccucaagagcacacaggccgccaucaaucaaauuaacggcaaacugaauagacuuaucgagaagaccaacgaaaaguuucaucagaucgagaaagaauuuucugagguggaagggcgcauucaggaucuggagaaguacguugaggacacgaaaaucgaucucugguccuauaaugcugaacugcugguggcgcucgagaaccagcacacaauugaccugaccgauagcgaaaugaacaaacuuuucgagcggaccagaaagcaacugcgcgaaaaugccgaggacaugggaaacggcugcuuuaagaucuaccauaagugugauaaugcuugcauugggucuauccggaacggaacauacgaccacgacgucuauagagaugaggcccucaauaaccgcuuccagauuaaaggcguggaacugaaguccggguacaaagacuggauccuuuggaucagcuuugccauuuccugcuuccugcucuguguugugcugcugggcuuuaucaugugggcuugccagaagggaaauauucgguguaacaucugcauuuga

SEQ ID NO: 183462 - RNA, 1701 nt, Artificial Sequence
  derived and/or modified sequence opt5 from hemagglutinin__InfluenzaA__ABB77853
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacaaagcgcagccagcaaaccgucauuccgaacaucggauccagacccugggugcggggcgugagcucucgcauuuccaucuauuggacaauugucaaaccuggggacauccugcugaucaacagcaccggaaaucucauugcccccagaggcuacuucaagauccggucuggaaagagcuccauuaugcgcucugacgcuccuaucgggaaauguaacagcgagugcauuacccccgauggcuccaucccgaaugacaagccuuuucagaacguuaauagaaucacauauggcgccuguccccgguacgugaaacagaacacgcugaaacuugcgaccgggaugcgcaaugugccugaaaagcagacaagaggaauuuucggcgccaucgcuggguuuauugagaacggaugggaaggcauggucgaugggugguauggauuccggcaccaaaauagcgagggcaccggccaggccgcugaccugaagucuacacaggccgccaucaaccaaauuaaugggaaacucaacagacugaucgagaagaccaaugaaaaguuucaucagaucgagaaagaguucuccgaaguggaaggacgcauucaggaucuugagaaguacguugaggacacgaaaaucgaucuguggagcuauaacgcugaacuccugguggcgcuggagaaucagcacacaauugaccucaccgauucugaaaugaacaagcuguucgagcggaccagaaaacaacuucgcgaaaacgccgaggacaugggcaaugggugcuuuaagaucuaccauaagugugauaacgcuugcauuggauccauccggaauggcacauacgaccacgacgucuauagagaugaggcccugaacaaucgcuuccagauuaaagggguggaacucaagagcggcuacaaagacuggauccuguggaucuccuuugccauuucuugcuuccuucuguguguugugcuccugggauuuaucaugugggcuugccagaagggcaacauucgguguaauaucugcauuuga

SEQ ID NO: 183463 - RNA, 1701 nt, Artificial Sequence
  derived and/or modified sequence opt5 from hemagglutinin__InfluenzaA__ABB79731
augaagaccaucauugcccugagcuacauccucugccugguguucgcucaggagcuucccggcaacgacaauuccacagccacgcugugucucgggcaccaugcggucccuaacggaaccauuguuaaaacaaucaccaaugaucaaauugaagugacaaacgcuaccgagcuggugcaaaauucuagcacaggcgggaucugcgacuccccgcaccagauccuugauggagaaaacuguacccugauugacgcccuccugggcgauccccagugcgacggguuucagaauaagaaaugggaucuguucgucgagagaucuaaggccuauagcaacuguuacccuuaugacgugcccgauuacgcuucccuccggucucugguugccagcuccggaacgcuugaauuuaauaacgagagcuucaauuggaccggcgugacacagaacggcaccucuuccgcuugcaaacgcagaagcaauaacucuuucuucucccggcugaauuggcucacacaucugaaguuuaaguauccugcccuuaacgucaccaugcccaacaaugagaaauucgacaagcuguacaucuggggagugcaccauccugggacggauaacgaccagacaagccucuaugcgcaggccucuggccgcauuaccguuuccacaaaaagaagccaacagaccgugaucccgaauauugggucccggccccgcgucagagauaucccuucucggauuagcaucuacuggaccaucgugaagcccggagacauucugcugaucaacuccacaggcaaucucauugcuccucgcggguacuuuaaaaucagaagcggaaagucuuccauuaugcggagcgacgcccccaucggcaaguguaacucugaaugcaucacgccgaauggcagcauuccuaacgauaaacccuuccagaaugugaaccgcaucaccuauggggcuuguccuagauacgucaagcagaauacacugaaacuugccaccggaaugcggaacguucccgagaagcaaacacgcggcauuuuuggggcgaucgccggauucauugaaaauggcugggaggggaugguggacggaugguauggcuuuagacaccagaacuccgagggcaucgggcaggcugccgaucugaaaucuacccaagcugccaucaaucagauuaacggaaagcucaaccggcugaucggcaaaacgaaugaaaaguuccaccagauugagaaggaauuuagcgagguggaagggagaauccaggaccuugagaaauacgucgaggauacaaagauugaccugugguccuauaacgccgaacuccugguggcucuggagaaucaacauaccaucgaucucaccgacagcgaaaugaacaaacuguuugagcgcacaaagaaacagcuucgggaaaaugcggaggauaugggaaacggcugcuucaagauuuaccacaagugugacaaugccugcaucgggucuaucagaaacggcaccuaugaucaugacguuuaccgcgacgaggcucugaauaaccgguuucagauuaaaggaguggaacucaaguccggcuacaaagauuggauccuguggauuagcuucgccaucucuugcuuucuucugugugucgcccuccugggguucauuaugugggcuugccagaagggaaauaucagauguaacaucugcauuuga

SEQ ID NO: 183464 - RNA, 1701 nt, Artificial Sequence
  derived and/or modified sequence opt5 from hemagglutinin__InfluenzaA__ABB79788
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuaugagagcgagucuaaguacccugugcugaacguuaccaugcccaauaacggcaaauuugacaaacuuuauaucuggggagugcaccauccuauuacagauaaggaacaaaccaaucuguacgucagagccuccgggcgggugacggugagcacaaagcgcucccagcagaccgucaucccgaacauuggcucuagacccuggguucgggggcucagcucccgcaucagcauuuacuggacaaucgugaaaccuggagacauccugcugauuaacucuaccggcaaucucaucgcgcccagaggcuauuucaagauucggaccgggaaguccagcaucaugcgcucugaugccccuauuggaacauguagcuccgagugcaucacgcccaacggcucuaucccgaaugacaaaccuuuucagaacgugaauaagauuaccuacggggcuugucccagauaugucaaacaaaacacacugaaacuugccaccggaaugcggaaugugccugaaaagcagacacgcggcaucuucggggcuauugccggauuuaucgagaacggcugggagggcaugguugacgggugguacggauucagacaccagaauagcgaaggcaccgggcaggcggccgaucugaaguccacgcaagcugccauugaccagaucaacggaaaacucaaucggcugaucgagaagacaaacgaaaaguuccaccagauugagaaagaauuuagcgagguggagggcagaauccaagaucuugaaaaguaugucgaggacaccaaaauugaucuguggucuuacaaugcugaacuccugguggcccuggagaaccagcauaccaucgaccucacagauuccgaaaugaauaagcuguucgagaaaacccgcaagcagcuucgggagaacgccgaagacauggggaacggcugcuuuaagauuuaucacaaaugugauaaugcuugcaucggaagcauuagaaacggcacauacgaccaugauguuuaccgcgacgaggcgcugaauaaccgguuccagaucaaggggguggaacucaaaucuggauauaaggacuggauccuguggauuuccuuugccaucagcugcuuccuucugugugucgugcuccugggcuuuauuaugugggcuugccaaaaagggaauaucagauguaacauuugcaucuga

SEQ ID NO: 183465 - RNA, 1701 nt, Artificial Sequence
  derived and/or modified sequence opt5 from hemagglutinin__InfluenzaA__ABB79799
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuaugagagcgagucuaaguacccugugcugaacguuaccaugcccaauaacggcaaauuugacaaacuuuauaucuggggagugcaccauccuuccacagauaaggaacaaaccaaucuguacgucagagccagcgggaaggugacgguguccacaaaacggucucagcagaccgucauuccgaacaucggcagccgccccuggguuagagggcucuccagccggauuucuaucuacuggacaauugugaagccuggagacauccugcugaucaacuccaccggcaaucucauugcgccccgcggcuauuucaagaucagaaccgggaaaagcucuauuaugcggagcgaugccccuaucggaacauguuccucugagugcauuacgcccaacggcagcaucccgaaugacaagccuuuucagaacgugaauaaaaucaccuacggggcuuguccccgcuaugucaagcaaaacacacugaaacuugccaccggaaugagaaaugugccugaaaagcagacacggggcauuuucggggcuaucgccggauuuauugagaacggcugggagggcaugguugacgggugguacggauuccgccaccaaaauuccgaaggcaccgggcaggcggccgaucugaaaagcacgcaggcugccaucgaccagauuaacggaaagcucaauagacugaucgagaagacaaacgaaaaauuccaccagaucgagaaggaauuuucugagguggagggccggauucaagaucuugaaaaauaugucgaggacaccaagaucgaucugugguccuacaaugcugaacuccugguggcccuggagaaccagcauaccauugaccucacagauagcgaaaugaauaaacuguucgagaagaccagaaagcagcuucgcgagaacgccgaagacauggggaacggcugcuuuaaaaucuaucacaagugugauaaugcuugcauuggaucuauccggaacggcacauacgaccaugauguuuacagagacgaggcgcugaauaaccgcuuccagauuaaagggguggaacucaaguccggauauaaagacuggauccuguggaucagcuuugccauuuccugcuuccuucugugugucgugcuccugggcuuuaucaugugggcuugccaaaaggggaauauucgguguaacaucugcauuuga

SEQ ID NO: 183466 - RNA, 1701 nt, Artificial Sequence
  derived and/or modified sequence opt5 from hemagglutinin__InfluenzaA__ABB79810
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagacugugcgacucuccgcaccggauucucgaugggaaaaauuguacccugaucgacgcccugcucggagauccccauugcgacggcuuucagaacaaggagugggaucuguucgucgaacgcagcaaagccuauuccaauuguuacccuuaugacgugcccgauuacgcuucucuuagaagccugguugccuccagcgggacgcucgaguuuaucaacgaagacuucaauuggaccggaguggcucaggauggcggcucuuaugccugccggcgcggguccgucaacagcuuuuucucuagacugaauuggcuucacaagcuggaguacaaguauccugcgcucaacgugacaaugcccaauaacggaaaauuugacaagcuguacauuuggggcguucaucacccuuccaccgauagcgaccaaacaucucuguacgugcgggccuccgggcgcgucaccgugagcacgaaaagaucccagcagacagugaucccgaauauuggaucucggcccuggguccgcggccagagcuccagaaucagcauuuauuggaccaucguuaagccuggggacauucuccugaucgauucuacaggaaaccuuaucgcuccccggggcuacuucaaaauucgcaacggcaaguccagcaucaugagaucugacgccccuauugggaauuguagcuccgagugcaucacccccaacggaucuauuccgaaugauaagccuuuucaaaacgugaaucggaucaccuauggcgcuuguccccgcuacgugaaacagcacacacugaagcucgccacggggaugagaaacgucccugaaaaacagacccggggaaucuucggcgcgauugccggguuuaucgagaauggaugggaaggcaugguggacggcugguauggguucagacaucagaacagcgagggaacaggccaagcugccgaucugaaguccacccaggcugccauugaccagaucaaugggaaacuuaaccgccugauugagaagacaaaugaaaaauuucaccaaaucgagaaggaguucagcgaaguugaaggacggauccaggaucucgagaaguacguggaggacaccaaaauugaucuguggucuuauaacgccgaacugcucgucgcucuggagaaucagcauacgaucgaccuuacagauuccgaaaugaacaagcuguucgagagaacccgcaaacagcuccgggaaaaugcggaggacaugggcaacgggugcuuuaagauuuaccacaaaugugacaacgccugcaucggcagcauuagaaauggaaccuacgaucacgacguguaucgcgaugaggcucugaacaaucgguuccaaaucaagggcguugaacuuaagucuggguacaaagacuggauucuguggaucuccuuugccaucagcugcuuccuccugugugugguccugcucggauuuauuaugugggccugccagaagggcaacaucagauguaauauuugcaucuga

SEQ ID NO: 183467 - RNA, 1701 nt, Artificial Sequence
  derived and/or modified sequence opt5 from hemagglutinin__InfluenzaA__ABB79957
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagacugugcgacucuccgcaccggauucucgaugggaaaaauuguacccugaucgacgcccugcucggagauccccauugcgacggcuuucagaacaaggagugggaucuguucgucgaacgcagcaaagccuauuccaauuguuacccuuaugacgugcccgauuacgcuucucuuagaagccugguugccuccagcgggacgcucgaguuuaucaacgaagacuucaauuggaccggaguggcucaggauggcggcucuuaugccugccggcgcggguccgucaacagcuuuuucucuagacugaauuggcuucacaagcuggaguacaaguauccugcgcucaacgugacaaugcccaauaacggaaaauuugacaagcuguacauuuggggcguucaucacccuuccaccgauagcgaccaaacaucucuguacgugcgggccuccgggcgcgucaccgugagcacgaaaagaucccagcagacagugaucccgaauauuggaucucggcccuggguccgcggccagagcuccagaaucgggauuuauuggaccaucguuaagccuggagacauucuccugaucaacagcacaggcaaccuuaucgcuccccggggcuacuucaaaauucgcaaugggaagucuuccaucaugagaagcgaugccccuauuggaaacuguucuagcgagugcaucacccccaauggcuccauuccgaacgacaagccuuuucaaaaugugaaccggaucaccuauggggcuuguccccgcuacgugaaacagcacacacugaagcucgccacgggaaugagaaaugucccugaaaaacagacccggggcaucuucggggcgauugccggauuuaucgagaacggcugggaaggcaugguggaugggugguauggauucagacaucagaauagcgagggcacagggcaagcugccgaccugaagucuacccaggcugccauugaucagaucaacggaaaacuuaaucgccugauugagaagacaaacgaaaaauuucaccaaaucgagaaggaguucuccgaaguugaaggccggauccaggaccucgagaaguacguggaggauaccaaaauugaccuguggagcuauaaugccgaacugcucgucgcucuggagaaccagcauacgaucgaucuuacagacucugaaaugaauaagcuguucgagagaacccgcaaacagcuccgggaaaacgcggaggauauggggaacggcugcuuuaagauuuaccacaaaugugacaaugccugcaucggauccauuagaaacggcaccuacgaccacgauguguaucgcgacgaggcucugaauaaccgguuccaaaucaaggggguugaacuuaagagcggauacaaagauuggauucuguggaucucuuuugccaucuccugcuuccuccugugugugguccugcucggcuuuauuaugugggccugccagaaggggaauaucagauguaacauuugcaucuga

SEQ ID NO: 183468 - RNA, 1701 nt, Artificial Sequence
  derived and/or modified sequence opt5 from hemagglutinin__InfluenzaA__ABB79968
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagacugugcgacucuccgcaccggauucucgaugggaaaaauuguacccugaucgacgcccugcucggagauccccauugcgacggcuuucagaacaaggagugggaucuguucgucgaacgcagcaaagccuauuccaauuguuacccuuaugacgugcccgauuacgcuucucuuagaagccugguugccuccagcgggacgcucgaguuuaucaacgaagacuucaauuggaccggaguggcucaggauggcggcucuuaugccugccggcgcggguccgucaacagcuuuuucucuagacugaauuggcuucacaagcuggaguacaaguauccugcgcucaacgugacaaugcccaauaacggaaaauuugacaagcuguacauuuggggcguucaucacccuuccaccgauagcgaccaaacaucucuguacgugcgggccuccgggcgcgucaccgugagcacgaaaagaucccagcagacagugaucccgaauauuggaucucggcccuggguccgcggccagagcuccagaaucagcauuuauuggaccaucguuaagccuggggacauucuccugaucaacucuacaggaaaccuuaucgcuccccggggcuacuucaaaauucgcaauggcaaguccagcaucaugagaucugaugccccuauugggaacuguagcuccgagugcaucacccccaauggaucuauuccgaacgacaagccuuuucaaaaugugaaccggaucaccuauggcgcuuguccccgcuacgugaaacagcacacacugaagcucgccacggggaugagaaaugucccugaaaaacagacccggggaaucuucggcgcgauugccggguuuaucgagaacggaugggaaggcaugguggauggcugguauggguucagacaucagaauagcgagggaacaggccaagcugccgaccugaaguccacccaggcugccauugaucagaucaacgggaaacuuaaucgccugauugagaagacaaacgaaaaauuucaccaaaucgagaaggaguucagcgaaguugaaggacggauccaggaccucgagaaguacguggaggauaccaaaauugaccuguggucuuauaaugccgaacugcucgucgcucuggagaaccagcauacgaucgaucuuacagacuccgaaaugaauaagcuguucgagagaacccgcaaacagcuccgggaaaacgcggaggauaugggcaacgggugcuuuaagauuuaccacaaaugugacaaugccugcaucggcagcauuagaaacggaaccuacgaccacgauguguaucgcgacgaggcucugaauaaccgguuccaaaucaagggcguugaacuuaagucuggguacaaagauuggauucuguggaucuccuuugccaucagcugcuuccuccugugugugguccugcucggauuuauuaugugggccugccagaagggcaauaucagauguaacauuugcaucuga

SEQ ID NO: 183469 - RNA, 1698 nt, Artificial Sequence
  derived and/or modified sequence opt5 from hemagglutinin__InfluenzaA__ABB79979
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuaucacuggacgcuucuggaacccggcgauacaauuaucuuugaggcgaacgggaaucucauugccccuugguacgcuuucgcccuguccagaggauuuggcagcggcaucauuaccucuaacgcucccauggacgagugugaugccaagugccagacaccgcaaggggcgaucaauuccagccuuccuuuccagaacgugcaucccgucaccaucggagaauguccuaaguaugugcggucugccaaacugcgcaugguuaccggccucagaaauauucccagcauccagucccgggggcuguuuggagcuauugccggcuucaucgaagggggauggacaggcaugguggacggcugguacggguaucaccaccagaacgaacaaggaucuggcuacgcugccgaucaaaagagcacgcagaaugccauuaacgggaucaccaauaaagucaacuccgugaucgagaagaugaauacacaguuuaccgcuguuggaaaagaguucaacaagcuggagcgcagaauggagaaucucaacaaaaagguggacgauggcuuccuggacauuuggacauacaacgcggaacuucugguccuccuggagaaugaacggacccuugacuuucaugauagcaacgugaagaaucuguaugagaaagucaagucucagcucaaaaacaaugccaaggaaaucgggaacggcugcuucgaguuuuaccacaaauguaauaacgagugcauggaauccgugaagaauggaacguaugacuaccccaaguauagcgaggaaucuaaacugaaccgcgagaagauugauggcguuaaacuggaguccauggggguguaccagauccucgcuauuuauagcacagucgccuccucucuggugcuucugguuagccucggagccaucuccuucuggaugugcucuaauggcagccugcaguguagaaucugcauuuga

SEQ ID NO: 183470 - RNA, 1698 nt, Artificial Sequence
  derived and/or modified sequence opt5 from hemagglutinin__InfluenzaA__ABB79990
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagaaggcccuguaccacacagagaacgcuuaugugagcgucguuuccucucauuacagcagacgguucacccccgaaauugccaaacgcccuaaggugagagaccaggagggacggaucaauuauuacuggacgcuucuggaacccggcgauacaauuaucuuugaggcgaacgggaaucucauugccccuugguaugcuuucgcccugucccgcggauuuggcagcggcaucauuaccucuaacgcucccauggacgagugugaugccaagugccagacaccgcaaggggcgaucaauuccagccuuccuuuccagaacgugcaccccgucaccaucggagaauguccuaaauacgugagaucugccaagcugcggaugguuaccggccuccgcaauauucccagcauccaguccagagggcuguuuggagcuauugccggcuucaucgaagggggauggacaggcaugguggacggcugguauggguaccaucaccagaacgaacaaggaucuggcuacgcugccgaucagaaaagcacgcagaaugccauuaacgggaucaccaauaaggucaacuccgugaucgagaaaaugaauacacaguuuaccgcuguuggaaaggaguucaacaaacuggagcggcgcauggagaaucucaacaagaagguggacgauggcuuccuggacauuuggacauauaacgcggaacuucugguccuccuggagaaugaaagaacccuugacuuucacgauagcaacgugaaaaaucuguacgagaaggucaaaucucaacucaagaacaaugccaaagaaaucgggaacggcugcuucgaguuuuaucauaaguguaauaacgagugcauggaauccgugaagaauggaacguacgacuaucccaaauacagcgaggaaucuaagcugaaccgggagaaaauugauggcguuaagcuggaguccauggggguguaucagauccucgcuauuuacagcacagucgccuccucucuggugcuucugguuagccucggagccaucuccuucuggaugugcucuaauggcagccugcagugucgcaucugcauuuga

SEQ ID NO: 183471 - RNA, 1701 nt, Artificial Sequence
  derived and/or modified sequence opt5 from hemagglutinin__InfluenzaA__ABB80001
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucaacuggacaggcgugacccagaauggcacauccagcgcuugcaagcgcagaucuaacaauuccuuuuucagccggcugaacuggcucacccaucugaaguuuaaauauccugcccuuaaugucacgaugcccaacaacgagaaguucgacaaacuguacauuuggggagugcaccauccugggacagauaaugaccagaucucucucuaugcgcaggccuccggccgcauuaccguuagcacaaagagaucccaacagaccgugaucccgaacauugggucucggccccgcgucagagauaucccuagccggauuuccaucuacuggaccaucgugaaacccggagacauucugcugaucaauagcacaggcaaccucauugcuccucgcggguacuuuaagaucagaucuggaaaguccagcauuaugcggucugacgcccccaucggcaaauguaauagcgagugcaucacgccgaacggcuccauuccuaaugauaagcccuuccagaacgugaaucgcaucaccuauggggcuuguccuagauacgucaaacagucuacacugaaacuugccaccggaaugcggaacguucccgaaaaacaaacacgcggcauuuuuggggcgaucgccggauucauugagaauggcugggaagggaugguggacggaugguauggcuuuagacaccagaacagcgagggcaucgggcaggcugccgaucugaaguccacccaagcugccaucaaucagauuaacggaaaacucaaucggcugaucggcaagacgaacgagaaguuccaccagauugaaaaagaguucagcgaaguggaggggagaauccaggaccuugaaaaguacgucgaggauacaaaaauugaccuguggucuuauaacgccgagcuccugguggcucuggaaaaucaacauaccaucgaucucaccgacuccgagaugaacaagcuguuugaacgcacaaagaagcagcuucgggagaaugcggaagauaugggaaacggcugcuucaagauuuaccacaaaugugacaaugccugcaucgggagcaucagaaacggcaccuaugaucaugacguuuaccgcgacgaggcucugaauaaccgguuucagauuaagggaguggagcucaaaucuggcuacaaggauuggauccuguggauuuccuucgccaucagcugcuuucuucugugugucgcccuccugggguucauuaugugggcuugccagaaaggaaauaucagauguaacaucugcauuuga

SEQ ID NO: 183472 - RNA, 1701 nt, Artificial Sequence; identical to SEQ ID NO: 183267
  derived and/or modified sequence opt5 from hemagglutinin__InfluenzaA__ABB80012

SEQ ID NO: 183473 - RNA, 1701 nt, Artificial Sequence
  derived and/or modified sequence opt5 from hemagglutinin__InfluenzaA__ABB80023
augaagaccaucauugcccugagcuacaucuucuaucucgcucugggccaggaccuucccgggaacgauaauuccaaagccacacugugccucggacaccaugcggugccuaacggcacgcuggucaagaccauuacaaaugaccaaaccgagguuacaaacgcuaccgaacuugugcagucuagcuccacagggaaaaucuguaauaacccgcaccggauucuggauggaauggacugcacccucaucgaugcccugcugggcgacccccauugugauguguuucagaaugagacgugggaccucuucgucgaaagaucuaaggccuuuagcaacugcuacccuuaugaugugcccgacuacgcuucccugcgcucucuuguugccagcuccgggacccuggaguucaucacagaaggauuuaccuggacagaggugacccagaauggcggcagcaacgcuuguaaaagagggccugauucuggauucuuuucccggcucaauuggcugacgaaaagcggccgcacauaucccguccuuaacgugaccaugccuaauaacgacaauuucgauaagcuguacauuuggggaguucaccauccgucuacagaccaagagcagaccaaccucuaugugcagaccuccgggagagucacagugagcacgcggcgcucucagcaaaccaucauucccaacaucggcuccagaccuugggugcgggggcugagcucccgcauuucuaucuacuggacaauugucaaacccggagacguucuggugaucaauagcaacggcaaucucaucgccccuagaggcuacuuuaagaugcggaccgggaaauccagcauuaugcgcucugaugcgcccaucgacacaugcauuuccgaauguaucaccccgaacggaagcauuccuaaugauaagcccuuccagaacgugaauaaaaucacguauggcgccugcccuaaguacgucaagcaggacacacugaaacuugcuaccgggaugagaaacgugcccgagaagcagacccggggacuguuuggcgccaucgcuggguucauugaaaauggaugggagggcaugaucgauggcugguauggguuucgccaccaaaacucugagggaacaggccaggccgcggaccucaaaagcacccaggccgcuauugaucaaaucaaugggaagcugaacagaauuaucgaaaagacaaaugagaaguuccaccagaucgaaaaagaguucuccgaaguugagggacggauucaggaccuugagaaguacguggaagauacgaagaucgaccuguggucuuauaacgccgagcuccuggucgcucuggaaaaucagcauaccauugaucucacagacagcgagaugaacaaacuguuugaaaagaccagacgccaacuucgggagaacgccgaggacaugggcaauggguguuucaaaaucuaccacaagugcgauaacgccuguauugaauccaucagaaauggcacauaugaccaugauguguaccgcgacgaggcucugaacaaucgguuucagauuaaaggaguugaacucaagagcggcuacaaggauuggauccuguggaucucuuucgcgauuuccugcuuucuucugugcgugguccuccugggguucaucaugugggccugucagagaggaaacauucgcugcaauaucuguauuuga

SEQ ID NO: 183474 - RNA, 1701 nt, Artificial Sequence
  derived and/or modified sequence opt5 from hemagglutinin__InfluenzaA__ABB80034
augaagaccaucauugcccugagcuacaucuucugccucgugcugggccaggaccuucccgggaacgauaauuccacagcuacgcugugucucggacaccaugccgucccuaacggcacccugguuaaaacaauuaccgacgaucaaaucgaggugacaaaugcgaccgaacuugugcagucuagcuccacagggaagauuugcaacaauccgcacagaauccuggacggacucgauuguacccugaucgacgcucugcucggcgauccccauugcgacgucuuucagaacgagacgugggaucuguucguggaacggucuaaagccuuuagcaauuguuauccuuacgacguucccgauuaugccucccuucgcucucugguggcuagcuccgggacccucgaguucauuacagaaggauuuaccuggacaggcgucacccagaacggcgggagcaaugccugcaagagaggaccuggcucuggguucuuuucccggcugaacuggcuuacgaaaagcggaucuacauaccccgugcugaauguuaccaugccuaacaaugacaacuucgauaagcucuauaucuggggcgugcaccauccguccacaaaucaagagcagaccagccuguacguccaggcuucugggcgcgugaccguguccacaagacggagccagcaaacgauuauccccaacauuggaucccgcccuugggucagaggccugucuagccggaucuccauuuauuggaccaucguuaagcccggcgacgugcucgugaucaacagcaaugggaaccugauugccccucgcggauacuuuaaaaugagaacaggcaagucuuccaucaugcggagcgacgcgaccauugauacauguaucucugagugcauuacccccaaugggagcaucccgaacgacaaaccuuuccagaaugucaacaagaucacguacggagccugucccaaauaugugaagcagaauacacuuaagcuggcuaccggcaugcgcaacguuccugaaaaacagaccagagggcucuuuggagccauugcuggcuucaucgagaauggcugggaagggaugauugauggaugguacggcuuucggcaccaaaacuccgaggggacaggacaggccgcggaccugaagucuacccaggccgcuaucgaucaaauuaauggcaaacuuaaccgcgugaucgagaagacaaaugaaaaauuccaccagaucgagaaggaguucagcgaagucgaagggcggauucaggaccuggagaaauauguggaggauacgaagaucgaccucugguccuacaacgccgaacugcugguugcucucgagaaucagcauaccauugaucugacagacagcgaaaugaacaaacuuuuugagaagaccagaagacaacugcgcgaaaacgccgaggauaugggcaauggaugcuucaagaucuaucacaaaugugacaacgccugcauugagucuauccggaauggcacauacgaccaugauguguauagagacgaagcucucaacaaucgcuuucagauuaagggggucgagcugaaauccggauacaaggauuggauccuuuggaucagcuucgcgauuucuugcuuucugcucugugugguccugcugggcuucaucaugugggccugccagcgggggaacauuagauguaauaucugcauuuga

SEQ ID NO: 183475 - RNA, 1698 nt, Artificial Sequence; identical to SEQ ID NO: 183388
  derived and/or modified sequence opt5 from hemagglutinin__InfluenzaA__ABB80045

SEQ ID NO: 183476 - RNA, 1701 nt, Artificial Sequence
  derived and/or modified sequence opt5 from hemagglutinin__InfluenzaA__ABB80081
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacaaagcgcagccagcaaaccgucauuccgaacaucggauccagacccugggugcggggcgugagcucucgcauuuccaucuauuggacaauugucaaaccuggggacauccugcugaucaacagcaccggaaaucucauugcccccagaggcuacuucaagauccggucuggaaagagcuccauuaugcgcucugacgcuccuaucgggaaauguaacagcgagugcauuacccccaauggcuccaucccgaacgauaagccuuuucagaauguuaacagaaucacauauggcgccuguccccgguacgugaaacagaauacgcugaaacuugcgaccgggaugcgcaacgugccugaaaagcagacaagaggaauuuucggcgccaucgcuggguuuauugagaauggaugggaaggcauggucgacgggugguauggauuccggcaccaaaacagcgagggcaccggccaggccgcugaucugaagucuacacaggccgccaucaaucaaauuaacgggaaacucaauagacugaucgagaagaccaacgaaaaguuucaucagaucgagaaagaguucuccgaaguggaaggacgcauucaggaccuugagaaguacguugaggauacgaaaaucgaccuguggagcuauaaugcugaacuccugguggcgcuggagaaccagcacacaauugaucucaccgacucugaaaugaacaagcuguucgagcggaccagaaaacaacuucgcgaaaaugccgaggauaugggcaacgggugcuuuaagaucuaccauaagugugacaaugcuugcauuggauccauccggaacggcacauacgaucacgacgucuauagagacgaggcccugaauaaccgcuuccagauuaaagggguggaacucaagagcggcuacaaagauuggauccuguggaucuccuuugccauuucuugcuuccuucuguguguugugcuccugggauuuaucaugugggcuugccagaagggcaauauucgguguaacaucugcauuuga

SEQ ID NO: 183477 - RNA, 1701 nt, Artificial Sequence
  derived and/or modified sequence opt5 from hemagglutinin__InfluenzaA__ABB80092
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacaaagcgcagccagcaaaccgucauuccgaacaucggauccagacccugggugcggggcgugagcucucgcauuuccaucuauuggacacuggucaaaccuggggacauucugcucaucaacagcaccggaaaucugaucgcccccagaggcuacuucaagauucggucuggaaagagcuccaucaugcgcucugacgcuccuauugggaaauguaacagcgagugcaucacccccaauggcuccauuccgaacgauaagccuuuucagaauguuaacagaaucacauauggcgccuguccccgguacgugaaacagaauacgcuuaagcuggcgaccgggaugcgcaacgugccugaaaaacagacaagaggaaucuucggcgccauugcuggguuuaucgagaauggaugggaaggcauggucgacgggugguauggauuccggcaccaaaacagcgagggcaccggccaggccgcugaucucaagucuacacaggccgccauuaaucaaaucaacgggaaacugaauagacuuauugagaagaccaacgaaaaguuucaucagaucgagaaagaguucuccgaaguggaaggacgcauccaggaccuggagaaguacguugaggauacgaaaauugaccucuggagcuauaaugcugaacugcugguggcgcucgagaaccagcacacaaucgaucugaccgacucugaaaugaacaagcuguucgagcggaccagaaaacaacugcgcgaaaaugccgaggauaugggcaacgggugcuuuaagauuuaccauaagugugacaaugcuugcaucggauccauucggaacggcacauacgaucacgacgucuauagagacgaggcccucaauaaccgcuuccagaucaaagggguggaacuuaagagcggcuacaaagauuggauucuuuggaucuccuuugccaucucuugcuuccugcucuguguugugcugcugggauuuauuaugugggcuugccagaagggcaauauccgguguaacauuugcaucuga

SEQ ID NO: 183478 - RNA, 1701 nt, Artificial Sequence; identical to SEQ ID NO: 183279
  derived and/or modified sequence opt5 from hemagglutinin__InfluenzaA__ABB80137

SEQ ID NO: 183479 - RNA, 1701 nt, Artificial Sequence; identical to SEQ ID NO: 183476
  derived and/or modified sequence opt5 from hemagglutinin__InfluenzaA__ABB80159

SEQ ID NO: 183480 - RNA, 1701 nt, Artificial Sequence; identical to SEQ ID NO: 183047
  derived and/or modified sequence opt5 from hemagglutinin__InfluenzaA__ABB80185

SEQ ID NO: 183481 - RNA, 1701 nt, Artificial Sequence
  derived and/or modified sequence opt5 from hemagglutinin__InfluenzaA__ABB80207
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacgauuuucagaacaaagaaugggaccucuucgucgagcgcagcaaggccuauuccaauuguuacccuuaugaugugcccgacuacgcuucucugagaagccuuguugccuccagcggcacgcuggaauuuaacaaugagucuuucaacuggaccgggguggcucagaauggaacauccuaugccugcaaacggcgcagcauuaagucuuucuucuccagacucaacuggcugcaccaacuuaaguacaaauauccugcgcugaaugucaccaugcccaacaaugauaaguuugacaaacucuacaucuggggcgugcaucacccuagcacagauucugaccagaccucccuguacgcccaggcuagcggccggguuacgguguccacaaagcgcucucagcaaaccgucauuccgaacaucgggagcagacccugggugcggggaguguccagccgcauuucuaucuauuggacaauugucaaaccuggcgacauccugcucaucaacuccaccgggaaucugauugcccccagaggauacuucaagauccggagcggcaagucuagcauuaugcgcuccgaugcuccuaucgggaaauguaacucugagugcauuacccccaauggaagcaucccgaacgacaagccuuuucagaauguuaacagaaucacauauggcgccuguccccgguacgugaaacagaauacgcuuaagcuggcgaccggcaugcgcaacgugccugaaaaacagacaagagggauuuucggagccaucgcuggcuuuauugagaaugggugggaaggaauggucgauggcugguauggguuccggcaccaaaacuccgagggaaccggccaggccgcugaccucaagagcacacaggccgccaucaaucaaauuaacggcaaacugaauagacuuaucgagaagaccaacgaaaaguuucaucagaucgagaaagaauuuucugagguggaagggcgcauucaggaucuggagaaguacguugaggacacgaaaaucgaucucugguccuauaaugcugaacugcugguggcgcucgagaaccagcacacaauugaccugaccgauagcgaaaugaacaaacuuuucgagcggaccagaaagcaacugcgcgaaaaugccgaggacaugggaaacggcugcuuuaagaucuaccauaagugugauaaugcuugcauugggucuauccggaacggaacauacgaccacgacgucuauagagaugaggcccucaauaaccgcuuccagauuaaaggcguggaacugaaguccggguacaaagacuggauccuuuggaucagcuuugccauguccugcuuccugcucuguguugugcugcugggcuuuauuaugugggcuugccagaagggaaauauccgguguaacauuugcaucuga

SEQ ID NO: 183482 - RNA, 1701 nt, Artificial Sequence
  derived and/or modified sequence opt5 from hemagglutinin__InfluenzaA__ABB80229
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccuaugccugcaaacggcgcagcauuaagucuuucuucuccagacucaacuggcugcaccaacuuaaguacaaauauccugcgcugaaugucaccaugcccaacaaugacaaguuugauaaacucuacaucuggggcgugcaucacccuagcacagacucugaucagaccucccuguacgcccaggcuagcgggcggguuacgguguccacaaagcgcucucagcaaaccgucauuccgaacaucggaagcagacccugggugcggggcguguccagccgcauuucuaucuauuggacaauugucaaaccuggggacauccugcucaucaacuccaccggaaaucugauugcccccagaggcuacuucaagauccggagcgggaagucuagcauuaugcgcuccgacgcuccuaucggaaaauguaacucugagugcauuacccccaauggcagcaucccgaacgauaagccuuuucagaauguuaacagaaucacauauggcgccuguccccgguacgugaaacagaauacgcuuaagcuggcgaccgggaugcgcaacgugccugaaaaacagacaagaggaauuuucggcgccaucgcuggguuuauugagaauggaugggaaggcauggucgacgggugguauggauuccggcaccaaaacuccgagggcaccggccaggccgcugaucucaagagcacacaggccgccaucaaucaaauuaacgggaaacugaauagacuuaucgagaagaccaacgaaaaguuucaucagaucgagaaagaauuuucugagguggaaggacgcauucaggaccuggagaaguacguugaggauacgaaaaucgaccucugguccuauaaugcugaacugcugguggcgcucgagaaccagcacacaauugaucugaccgacagcgaaaugaacaaacuuuucgagcggaccagaaagcaacugcgcgaaaaugccgaggauaugggcaacgggugcuuuaagaucuaccauaagugugacaaugcuugcauuggaucuauccggaacggcacauacgaucacgacgucuauagagacgaggcccucaauaaccgcuuccagauuaaagggguggaacugaaguccggcuacaaagauuggauccuuuggaucagcuuugccauguccugcuuccugcucuguguugugcugcugggauuuauuaugugggcuugccagaagggcaauauccgguguaacauuugcaucuga

SEQ ID NO: 183483 - RNA, 1701 nt, Artificial Sequence; identical to SEQ ID NO: 183476
  derived and/or modified sequence opt5 from hemagglutinin__InfluenzaA__ABB80240

SEQ ID NO: 183484 - RNA, 1701 nt, Artificial Sequence
  derived and/or modified sequence opt5 from hemagglutinin__InfluenzaA__ABB80251
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuuccgggcggguuacggugucuacaaagcgcagccagcaaaccgucauuccgaacaucggauccagacccugggugcggggcgugagcucucgcauuuccaucuacuggacaauugucaaaccuggggacauccugcucaucaacagcaccggaaaucugauugcccccagaggcuauuucaagauccggucuggaaagagcuccauuaugcgcucugacgcuccuaucgggaaauguaacagcgagugcauuacccccaauggcuccaucccgaacgauaagccuuuucagaauguuaacagaaucacauacggcgccuguccccgguaugugaaacagaauacgcuuaagcuggcgaccgggaugcgcaacgugccugaaaaacagacaagaggaauuuucggcgccaucgcuggguuuauugagaauggaugggaaggcauggucgacgggugguacggauuccggcaccaaaacagcgagggcaccggccaggccgcugaucucaagucuacacaggccgccaucaaucaaauuaacgggaaacugaauagacuuaucgagaagaccaacgaaaaguuucaucagaucgagaaagaguucuccgaaguggaaggacgcauucaggaccuggagaaguauguugaggauacgaaaaucgaccucuggagcuacaaugcugaacugcugguggcgcucgagaaccagcacacaauugaucugaccgacucugaaaugaacaagcuguucgagcggaccagaaaacaacugcgcgaaaaugccgaggauaugggcaacgggugcuuuaagaucuaucauaagugugacaaugcuugcauuggauccauccggaacggcacauacgaucacgacgucuacagagacgaggcccucaauaaccgcuuccagauuaaagggguggaacuuaagagcggcuauaaagauuggauccuuuggaucuccuuugccauuucuugcuuccugcucuguguugugcugcugggacucaucaugugggcuugccagaagggcaauauucgguguaacaucugcauuuga

SEQ ID NO: 183485 - RNA, 1701 nt, Artificial Sequence
  derived and/or modified sequence opt5 from hemagglutinin__InfluenzaA__ABB80492
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagaauagcagcacaggcagaauuugcgacuccccgcaccggauccuggauggggagaacuguacccucaucgacgcccugcugggagauccccauugcgacggcuuucagaauaaagaaugggaucucuucgucgagcgcucuaaggccuauagcaacuguuacccuuaugacgugcccgauuacgcuucccugagaucucuuguugccagcuccgggacgcuggaauuuaauaacgagagcuucaauuggaccggaguggcucagaacggcacaucuuaugccugcaaacggcgcuccauuaagagcuuuuucucuagacucaauuggcugcaccaacuuaaguacaaauauccugcgcugaacgucaccaugcccaauaacgacaaguuugauaaacucuacaucuggggcgugcaucacccuuccacagacagcgaucagaccucucuguacgcccaggcuuccgggcggguuacggugagcacaaagcgcucccagcaaaccgucauuccgaacaucggaucuagacccugggugcggggcgugagcucccgcauuagcaucuauuggacaauugucaaaccuggggacauccugcucaucaauucuaccggaaaccugauugcccccagaggcuacuucaagauccgguccgggaagucuucuauuaugcgcagcgacgcuccuaucggaaaauguaauuccgagugcauuacccccaacggcucuaucccgaaugauaagccuuuucagaacguuaauagaaucacauauggcgccuguccccgguacgugaaacagaacacgcuuaagcuggcgaccgggaugcgcaaugugccugaaaaacagacaagaggaauuuucggcgccaucgcuggguuuauugagaacggaugggaaggcauggucgacgggugguauggauuccggcaccaaaauagcgagggcaccggccaggccgcugaucucaaguccacacaggccgccaucaaccaaauuaaugggaaacugaacagacuuaucgagaagaccaaugaaaaguuucaucagaucgagaaagaguucagcgaaguggaaggacgcauucaggaccuggagaaguacguugaggauacgaaaaucgaccucuggucuuauaacgcugaacugcugguggcgcucgagaaccagcacacaauugaucugaccgacuccgaaaugaauaaacuuuucgagcggaccagaaagcaacugcgcgaaaacgccgaggauaugggcaaugggugcuuuaagaucuaccauaagugugacaacgcuugcauuggaagcauccggaauggcacauacgaucacgacgucuauagagacgaggcccucaacaaucgcuuccagauuaaagggguggaacugaagucuggcuacaaagauuggauccuuuggaucuccuuugccaugagcugcuuccugcucuguguugugcugcugggauuuauuaugugggcuugccagaagggcaacauccgguguaauauuugcaucuga

SEQ ID NO: 183486 - RNA, 1701 nt, Artificial Sequence
  derived and/or modified sequence opt5 from hemagglutinin__InfluenzaA__ABB80503
augaagaccaucauugcccugagcuacaucuccugccucguguucgcucagaaacugcccggcaacgacaauaacacagccacgcuuugucuggggcaccaugcggucccuaauggaacccucguuaagacaauuaccaacgaucaaaucgaggugacaaaugcuaccgaacuggugcagucuagcuccacaggcagaauuugcgacucuccgcaccggauccuugauggggagaacuguacccugaucgacgcccuccugggagauccccauugcgacggcuuucagaauaaagaaugggaucuguucgucgagcgcagcaaggccuauuccaacuguuacccuuaugacgugcccgauuacgcuucucucagaagccugguugccuccagcgggacgcuugaauuuaauaacgagucuuucaauuggaccggaguggcucagaacggcacauccuaugccugcaaacggcgcagcauuaagucuuucuucuccagacugaauuggcuccaccaacugaaguacaaauauccugcgcuuaacgucaccaugcccaauaacgacaaguuugauaaacuguacaucuggggcgugcaucacccuagcacagacucugaucagaccucccucuacgcccaggcuagcgggcggguuacgguguccacaaagcgcucucagcaaaccgucauuccgaacaucggaagcagacccugggugcggggcguguccagccgcauuucuaucuauuggacaauugucaaaccuggggacauccugcugaucaauuccaccggaaaccucauugcccccagaggcuacuucaagauccggagcgggaagucuagcauuaugcgcuccgacgcuccuaucggaaaauguaauucugagugcauuacccccaacggcagcaucccgaaugauaagccuuuucagaacguuaauagaaucacauauggcgccuguccccgguacgugaaacagaacacgcugaagcuggcgaccgggaugcgcaaugugccugaaaaacagacaagaggaauuuucggcgccaucgcuggguuuauugagaacggaugggaaggcauggucgacgggugguauggauuccggcaccaaaauuccgagggcaccggccaggccgcugaucuuaagagcacacaggccgccaucaaccaaauuaaugggaaacucaacagacugaucgagaagaccaaugaaaaguuucaucagaucgagaaagaauuuucugagguggaaggacgcauucaggaccuugagaaguacguugaggauacgaaaaucgaccugugguccuauaacgcugaacuccugguggcgcuggagaaccagcacacaauugaucucaccgacagcgaaaugaauaagcuguucgagcggaccagaaaacaacuucgcgaaaacgccgaggauaugggcaaugggugcuuuaagaucuaccauaagugugacaacgcuugcauuggaucuauccggaauggcacauacgaucacgacgucuauagagacgaggcccugaacaaucgcuuccagauuaaagggguggaacuccgguccggcuacaaggauuggauccuguggaucagcuuugccauuuccugcuuccuucuguguguugugcuccugggauuuaucaugugggcuugccagaaaggcaacauuagauguaauaucugcauuuga

SEQ ID NO: 183487 - RNA, 1701 nt, Artificial Sequence; identical to SEQ ID NO: 183476
  derived and/or modified sequence opt5 from hemagglutinin__InfluenzaA__ABB80514

SEQ ID NO: 183488 - RNA, 1701 nt, Artificial Sequence
  derived and/or modified sequence opt5 from hemagglutinin__InfluenzaA__ABB80529
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacaaagcgcagccagcaaaccgucauuccgaacaucggauccagacccugggugcggggcgugagcucucgcauuuccaucuauuggacaauugucaaaccuggggacauccugcugaucaacagcaccggaaaucucauugcccccagaggcuacuucaagauccggucuggaaagagcuccauuaugcgcucugacgcuccuaucgggaaauguaacagcgagugcauuacccccaauggcuccaucccgaacgauaagccuuuucagaauguuaacagaaucacauauggcgccuguccccgguacgugaaacagaauacgcugaaacuugcgaccgggaugcgcaacgugccugacaagcagacaagaggaauuuucggcgccaucgcuggguuuauugaaaauggaugggagggcauggucgaugggugguauggauuccggcaccaaaacagcgaaggcaccggccaggccgcugaccugaagucuacacaggccgccaucaaucaaauuaacgggaaacucaauagacugaucgagaagaccaacgagaaguuucaucagaucgaaaaagaguucuccgaaguggagggacgcauucaggaucuugaaaaguacguugaggacacgaaaaucgaucuguggagcuauaaugcugagcuccugguggcgcuggaaaaccagcacacaauugaccucaccgauucugagaugaacaagcuguucgaacggaccagaaaacaacuucgcgagaaugccgaagacaugggcaacgggugcuuuaagaucuaccauaagugugauaaugcuugcauuggauccauccggaacggcacauacgaccacgacgucuauagagaugaggcccugaauaaccgcuuccagauuaaagggguggagcucaagagcggcuacaaagacuggauccuguggaucuccuuugccauuucuugcuuccuucuguguguugugcuccugggauuuaucaugugggcuugccagaagggcaauauucgguguaacaucugcauuuga

SEQ ID NO: 183489 - RNA, 1701 nt, Artificial Sequence
  derived and/or modified sequence opt5 from hemagglutinin__InfluenzaA__ABB80641
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugucugauuacgcuagccucagaucccugguugccagcucugggacgcuugaauuuaacaaugaguccuucaacuggaccggaguggcucagaauggcacaagcuaugccugcaaacggcgcucuaucaaguccuuuuucagcagacugaacuggcuccaccaacugaaguacaaauaucccgcgcuuaaugucaccaugccuaacaaugacaaguuugauaaacuguacauuuggggcgugcaucaccccucuacagacuccgaucagaccagccucuacgcccaggcuuccgggcggguuacggugucuacaaagcgcagccagcaaaccgucaucccuaacauuggauccagaccgugggugcggggcgugagcucucgcaucuccauuuauuggacaaucgucaaacccggggacauccugcugauuaacagcaccggaaaucucaucgccccuagaggcuacuucaagauucggucuggaaagagcuccaucaugcgcucugacgcucccauugggaaauguaacagcgagugcaucaccccuaauggcuccauccccaacgauaagccguuucagaauguuaacagaauuacauauggcgccuguccucgguacgugaaacagaauacgcugaaacuugcgaccgggaugcgcaacgugcccgaaaagcagacaagaggaaucuucggcgccauugcuggguuuaucgagaauggaugggaaggcauggucgacgggugguauggauuccggcaccaaaacagcgagggcaccggccaggccgcugaucugaagucuacacaggccgccauuaaucaaaucaacgggaaacucaauagacugaucgagaagaccaacgaaaaguuucaucagauugagaaagaguucuccgaaguggaaggacgcauccaggaccuugagaaguacguugaggauacgaaaauugaccuguggagcuauaaugcugaacuccugguggcgcuggagaaccagcacacaaucgaucucaccgacucugaaaugaacaagcuguucgagcggaccagaaaacaacuucgcgaaaaugccgaggauaugggcaacgggugcuuuaagauuuaccauaagugugacaaugcuugcaucggauccauucggaacggcacauacgaucacgacgucuauagagacgaggcccugaauaaccgcuuccagaucaaagggguggaacucaagagcggcuacaaagauuggauccuguggauuuccuuugccaucucuugcuuccuucuguguguugugcuccugggauuuauuaugugggcuugccagaagggcaauauccgguguaacauuugcaucuga

SEQ ID NO: 183490 - RNA, 1701 nt, Artificial Sequence
  derived and/or modified sequence opt5 from hemagglutinin__InfluenzaA__ABB80661
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggcgcagcaucaagucuuucuucuccagacugaacuggcuccaccaacugaaguacaaauauccugcgcuuaaugucaccaugcccaacaaugacaaguuugauaaacuguacauuuggggcgugcaucacccuagcacagacucugaucaggccucccucuacgcucaggccagcgggcggguuaccguguccacgaagcgcucucagcaaacagucaucccgaacauuggaagcagacccugggugcggggcguguccagccgcaucucuauuuauuggaccaucgucaaaccuggggacauccugcugauuaacuccacaggaaaucucaucgcucccagaggcuacuucaagauucggagcgggaagucuagcaucaugcgcuccgacgccccuauuggaaaauguaacucugagugcaucacccccaauggcagcaucccgaacgauaagccuuuucagaauguuaacagaauuaccuauggcgcguguccccgguacgugaaacagaauacacugaagcuggccacggggaugcgcaacgugccugaaaaacagaccagaggaaucuucggcgcuauugccggguuuaucgagaauggaugggaaggcauggucgacgggugguauggauuccggcaccaaaacuccgagggcacaggccaggcugccgaucuuaagagcacccaggccgcuauuaaucaaaucaacgggaaacucaauagacugaucgagaagacaaacgaaaaguuucaucagauugagaaagaauuuucugagguggaaggacgcauccaggaccuugagaaguacguugaggauaccaaaauugaccugugguccuauaaugcggaacuccugguggcccuggagaaccagcacacgaucgaucucacagacagcgaaaugaacaagcuguucgagcggaccagaaaacaacuucgcgaaaaugcugaggauaugggcaacgggugcuuuaagauuuaccauaagugugacaaugccugcaucggaucuauucggaacggcaccuacgaucacgacgucuauagagacgaggcccugaauaaccgcuuccagaucaaagggguggaacucaaguccggcuacaaagauuggauccuguggauuagcuuugcuaucuccugcuuccuucuguguguugugcuccugggauuuauuaugugggccugccagaagggcaauauccgguguaacauuugcaucuga

SEQ ID NO: 183491 - RNA, 1701 nt, Artificial Sequence
  derived and/or modified sequence opt5 from hemagglutinin__InfluenzaA__ABB80672
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagggcucuagcacagggagaauuugcgacuccccgcaccagauccuggauggaaagaauuguacccucaucgacgcccugcugggcgauccccauugcgacggguuucagaacaaggagugggaucucuucgucgaacggucuacggccuauagcaauuguuacccuuaugacgugcccgauuacgcuucccugcgcucucuuguugccagcuccggaacccuggaguuuacaaaagaaggcuucaacuggaccggcguggcucaagacgggacaagcuaugccugcaagagaggaucugucaaguccuuuuucagccggcucaauuggcugcacaaacuugaguacaaguauccugcgcugaacgugaccaugcccaauaacgauaaauuugacaagcucuacauuuggggcguucaucacccuucuacggauuccgaccagacaagccuguacgugcaggccucugggcgcgucaccguguccacaaaaagaagccagcaaaccgugaucccgaauauuggaucccggcccuggguccgcggcguuucuagcagaaucuccauuuauuggaccaucgugaagccuggggacauucugcucaucaacagcacaggaaaucugaucgcuccccggggcuacuucaagauucgcucuggcaaauccagcaucaugagaucugaugccccuauugacaacuguaacagcgagugcaucacgcccaauggguccauuccgaacgauaagccuuuucagaaugugaaccggaucaccuauggagcuuguccccgcuacgucaaacagaauacacuuaagcuggccaccggcaugagaaacgugccugaaaaacagacacgggggaucuucggagcgauugccggcuuuaucgagaaugggugggaaggaaugguugacggcugguauggcuuccgccaccaaaacucugaggggaccggacaggcugccgaucucaagagcacgcaggcugccauuaaucaaaucaacggcaaacugaauagacuuauugagaagacaaacgaaaaguuucaucagaucgagaaagaguucuccgaaguggaagggcggauccaggaccuggagaaguacgucgaggauaccaaaauugaccucuggagcuauaaugccgaacugcugguggcucucgagaaccagcacaccaucgaucugacagacucugaaaugaauaaacuuuucgagagaacccgcaaacaacugcgggaaaacgcggaggauaugggaaacggcugcuuuaagauuuaccauaagugugacaaugccugcaucggguccauuagaaacggcacauacgaccacgauguuuaucgcgacgaggcucucaauaaccgguuccagaucaaaggaguggaacuuaagagcggcuacaaagauuggauucuguggaucucuuuugccaucuccugcuuccugcucugugucgugcugcugggguuuauuaugugggccugccagaagggaaauaucagauguaacauuugcaucuga

SEQ ID NO: 183492 - RNA, 1701 nt, Artificial Sequence
  derived and/or modified sequence opt5 from hemagglutinin__InfluenzaA__ABB80682
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacaaagcgcagccagcaaaccgucauuccgaacaucggauccagacccugggugcggggcgugagcucucgcauuuccaucuauuggacaauugucaaaccuggggacauccugcugaucaacagcaccggaaaucucauugcccccagaggcuacuucaagauccggucuggaaagagcuccauuaugcgcucugacgcuccuaucgggaaauguaacagcgagugcauuacccccaauggcuccaucccgaacgauaagccuuuucagaauguuaacagaaucacauauggcgccuguccccgguacgugaaacagaauacgcugaagcuggcgaccgggaugcgcaacgugccugaaaaacagacaagaggaauuuucggcgccaucgcuggguuuauugagaauggaugggaaggcauggucgacgggugguauggauuccggcaccaaaacagcgagggcaccggccaggccgcugaucugaagucuacacaggccgccaucaaucaaauuaacgggaaacucaauagacugaucgagaagaccaacgaaaaguuucaucagaucgagaaagaguucuccgaaguggaaggacgcauucaggaccuugagaaguacguugaggauacgaaaaucgaccuguggagcuauaaugcugaacuccugguggcgcuggagaaccagcacacaauugaucucaccgacucugaaaugaacaagcugcuugagcggaccagaaaacaacugcgcgaaaaugccgaggauaugggcaacgggugcuucaagaucuaccauaagugugacaaugcuugcauuggauccauccggaacggcacauacgaucacgacgucuauagagacgaggcccucaauaaccgcuuucagauuaaagggguggaacuuaagagcggcuacaaagauuggauccuuuggaucuccuucgccauuucuugcuuucugcucuguguugugcugcugggauucaucaugugggcuugccagaagggcaauauucgguguaacaucugcauuuga

SEQ ID NO: 183493 - RNA, 1701 nt, Artificial Sequence
  derived and/or modified sequence opt5 from hemagglutinin__InfluenzaA__ABB80693
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaaugugcgacagcccgcaccggauucuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuaucaaguccuuuuucagcagacugaacuggcuccaccaacugaaguacaaauauccugcgcuuaaugucaccaugcccaacaaugacaaguuugauaaacuguacauuuggggcgugcaucacccuucuacagacuccgaucagaccagccucuacgcccaggcuuccgggcggguuacggugucuacaaagcgcagccagcaaaccgucaucccgaacauuggauccagacccugggugcggggcgugagcucucgcaucuccauuuauuggacaaucgucaaaccuggggacauucugcugaucaacagcaccggaaaucucaucgcccccagaggcuacuucaagauucggucuggaaagagcuccaucaugcgcucugacgcuccuauugggaaauguaacagcgagugcaucacccccaauggcuccauuccgaacgauaagccuuuucagaauguuaacagaaucacauauggcgccuguccccgguacgugaaacagaauacgcugaaacuugcgaccgggaugcgcaacgugccugaaaagcagacaagaggaaucuucggcgccauugcuggguuuaucgagaauggaugggaaggcauggucgacgggugguauggauuccggcaccaaaacagcgagggcaccggccaggccgcugaucugaagucuacacaggccgccauuaaucaaaucaacgggaaacucaauagacugauugagaagaccaacgaaaaguuucaucagaucgagaaagaguucuccgaaguggaaggacgcauccaggaccuugagaaguacguugaggauacgaaaauugaccuguggagcuauaaugcugaacuccugguggcgcuggagaaccagcacacaaucgaucucaccgacucugaaaugaacaagcuguucgagcggaccagaaaacaacuucgcgaaaaugccgaggauaugggcaacgggugcuuuaagauuuaccauaagugugacaaugcuugcaucggauccauucggaacggcacauacgaucacgacgucuauagagacgaggcccugaauaaccgcuuccagaucaaagggguggaacucaagagcggcuacaaagauuggauucuguggaucuccuuugccaucucuugcuuccuucuguguguugugcuccugggauuuauuaugugggcuugccagaagggcaauauccgguguaacauuugcaucuga

SEQ ID NO: 183494 - RNA, 1701 nt, Artificial Sequence
  derived and/or modified sequence opt5 from hemagglutinin__InfluenzaA__ABB80704
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggcgcagcaucaagucuuucuucuccagacugaacuggcuccaccaacugaaguacaaauauccugcgcuuaaugucaccaugcccaacaaugacaaguuugauaaacuguacauuuggggcgugcaucacccuagcacagacucugaucagaccucccucuacgcccaggcuagcgggcggguuacgguguccacaaagcgcucucagcaaaccgucaucccgaacauuggaagcagacccugggugcggggcguguccagccgcaucucuauuuauuggacaaucgucaaaccuggggacauccugcugauuaacuccaccggaaaucucaucgcccccagaggcuacuucaagauucggagcgggaagucuagcaucaugcgcuccgacgcuccuauuggaaaauguaacucugagugcaucacccccaauggcagcaucccgaacgauaagccuuuucagaauguuaacagaauuacauauggcgccuguccccgguacgugaaacagaauacgcugaagcuggcgaccgggaugcgcaacgugccugaaaaacagacaagaggaaucuucggcgccauugcuggguuuaucgagaauggaugggaaggcauggucgacgggugguauggauuccggcaccaaaacuccgagggcaccggccaggccgcugaucuuaagagcacacaggccgccauuaaucaaaucaacgggaaacucaauagacugaucgagaagaccaacgaaaaguuucaucagauugagaaagaauuuucugagguggaaggacgcauccaggaccuugagaaguacguugaggauacgaaaauugaccugugguccuauaaugcugaacuccugguggcgcuggagaaccagcacacaaucgaucucaccgacagcgaaaugaacaagcuguucgagcggaccagaaaacaacuucgcgaaaaugccgaggauaugggcaacgggugcuuuaagauuuaccauaagugugacaaugcuugcaucggaucuauucggaacggcacauacgaucacgacgucuauagagacgaggcccugaauaaccgcuuccagaucaaagggguggaacucaaguccggcuacaaagauuggauccuguggauuagcuuugccaucuccugcuuccuucuguguguugugcuccugggauuuauuaugugggcuugccagaagggcaauauccgguguaacauuugcaucuga

SEQ ID NO: 183495 - RNA, 1701 nt, Artificial Sequence; identical to SEQ ID NO: 183476
  derived and/or modified sequence opt5 from hemagglutinin__InfluenzaA__ABB80715

SEQ ID NO: 183496 - RNA, 1701 nt, Artificial Sequence
  derived and/or modified sequence opt5 from hemagglutinin__InfluenzaA__ABB80724
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccuaugccugcaaacggcgcagcauuaagucuuucuucuccagacucaacuggcugcaccaacuuaaguacaaauauccugcgcugaaugucaccaugcccaacaaugacaaguuugauaaacucuacaucuggggcgugcaucacccuagcacagacucugaucaggccucccuguacgcucaggccagcgggcggguuaccguguccacgaagcgcucucagcaaacagucauuccgaacaucggaagcagacccugggugcggggcguguccagccgcauuucuaucuauuggaccauugucaaaccuggggacauccugcucaucaacuccacaggaaaucugauugcucccagaggcuacuucaagauccggagcgggaagucuagcauuaugcgcuccgacgccccuaucggaaaauguaacucugagugcauuacccccaauggcagcaucccgaacgauaagccuuuucagaauguuaacagaaucaccuauggcgcguguccccgguacgugaaacagaauacacuuaagcuggccacggggaugcgcaacgugccugaaaaacagaccagaggaauuuucggcgcuaucgccggguuuauugagaauggaugggaaggcauggucgacgggugguauggauuccggcaccaaaacuccgagggcacaggccaggcugccgaucucaagagcacccaggccgcuaucaaucaaauuaacgggaaacugaauagacuuaucgagaagacaaacgaaaaguuucaucagaucgagaaagaauuuucugagguggaaggacgcauucaggaccuggagaaguacguugaggauaccaaaaucgaccucugguccuauaaugcggaacugcugguggcccucgagaaccagcacacgauugaucugacagacagcgaaaugaacaaacuuuucgagcggaccagaaagcaacugcgcgaaaaugcugaggauaugggcaacgggugcuuuaagaucuaccauaagugugacaaugccugcauuggaucuauccggaacggcaccuacgaucacgacgucuauagagacgaggcccucaauaaccgcuuccagauuaaagggguggaacugaaguccggcuacaaagauuggauccuuuggaucagcuuugcuauguccugcuuccugcucuguguugugcugcugggauuuauuaugugggccugccagaagggcaauauccgguguaacauuugcaucuga

SEQ ID NO: 183497 - RNA, 1701 nt, Artificial Sequence; identical to SEQ ID NO: 183482
  derived and/or modified sequence opt5 from hemagglutinin__InfluenzaA__ABB80737

SEQ ID NO: 183498 - RNA, 1701 nt, Artificial Sequence
  derived and/or modified sequence opt5 from hemagglutinin__InfluenzaA__ABB80748
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucagaauggcacaagcuaugccugcaaacggcgcucuauuaaguccuuuuucagcagacugaacuggcuccaccaacugaaguacaaauauccugcgcuuaaugucaccaugcccaacaaugacaaguuugauaaacuguacaucuggggcgugcaucacccuucuacagacuccgaucagaccagccucuacgcccaggcuuccgggcggguuacggugucuacacagcgcagccaacagaccgucauuccgaacaucggauccagacccugggugcggggcgugagcucucgcauuuccaucuauuggacaauugucaagccuggggacauccugcugaucaacagcaccggaaaucucauugcccccagaggcuacuucaaaauccggucuggaaagagcuccauuaugcgcucugacgcuccuaucgggaaguguaacagcgagugcauuacccccaauggcuccaucccgaacgauaaaccuuuucagaauguuaacagaaucacauauggcgccuguccccgguacgugaagcagaauacgcugaaacuugcgaccgggaugcgcaacgugccugaaaagcaaacaagaggaauuuucggcgccaucgcuggguuuauugagaauggaugggaaggcauggucgacgggugguauggauuccggcaccagaacagcgagggcaccggccaggccgcugaucugaaaucuacacaagccgccaucaaucagauuaacgggaagcucaauagacugaucgagaaaaccaacgaaaaguuucaucagaucgagaaggaguucuccgaaguggaaggacgcauucaggaccuugaggaguacguugaagauacgaaaaucgaccuguggagcuauaaugcugagcuccugguggcgcuggaaaaccaacacacaauugaucucaccgacucugagaugaacaagcuguucgaacggaccagaaaacagcuucgcgagaaugccgaggauaugggcaacgggugcuuuaagaucuaccauaaaugugacaaugcuugcauuggauccauccggaacggcacauacgaucacgacgucuauagagacgaagcccugaauaaccgcuuccagauuaaggggguggagcucaagagcggcuacaaagauuggauccuguggaucuccuuugccauuucuugcuuccuucuguguguugugcuccugggauuuaucaugugggcuugccagaagggcaauauucgguguaacaucugcauuuga

SEQ ID NO: 183499 - RNA, 1701 nt, Artificial Sequence
  derived and/or modified sequence opt5 from hemagglutinin__InfluenzaA__ABB82183
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcuccccgcggcuauuucaagaucagaucugggaaaagcuccguuaugcggucugacgccagcauuggacgcuguaauuccgaaugcaucaccccuaacggcagcauucccaaugacaaaccguuucagaacgugaauagaaucaccuacggcgccuguccucgguaugugaagcagaacacacuuaaacuggcgacggggaugcgcaauguccccgagaagcaaaccagaggaaucuucggcgccauugcuggguuuaucgaaaacggaugggagggcaugguggaugggugguacggauuccggcaccaaaauucugagggcacaggccaggccgcugaccucaaauccacccaggccgccauuaaccagaucaaugggaagcugaacagacuuauugaaaagacaaaugagaaguuucaucagaucgaaaaggaguucagcgaaguugagggacgcauccaggaucuggagaaauauguggaagacaccaagauugaucucuggucuuacaacgcugagcugcuggucgcgcucgaaaaccaacacacgaucgaccugacagauuccgagaugaauaaacuuuucgaacggaccaagaaacagcugagagagaacgccgaggacaugggcaaugggugcuuuaagauuuaucauaagugugauaacgcuugcaucggaagcauucgcaauggcaccuacgaccacgauguguaccgggacgaagcccucaacaauagauuccagaucaaagggguugagcugaaguccggcuauaaagacuggauucuuuggaucucuuuugccaucagcugcuuccugcucugugugguccugcugggauuuauuaugugggcuugccagaagggcaacauccgcuguaauauuugcaucuga

SEQ ID NO: 183500 - RNA, 1698 nt, Artificial Sequence; identical to SEQ ID NO: 183320
  derived and/or modified sequence opt5 from hemagglutinin__InfluenzaA__ABB82194

SEQ ID NO: 183501 - RNA, 1698 nt, Artificial Sequence
  derived and/or modified sequence opt5 from hemagglutinin__InfluenzaA__ABB82205
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuacaaaaaucugcuuuggcugaccggcaagaacgggcucuaucccaaucugucuaaauccuacgcuaacagcaaggaaaaagaggugcugguccucuggggagugcaucacccuccgaauaucggcgaucagcgcgcccuguaccacacagaaaacgcuuauguguccgucguuucuagccauuacuccagacgguucacccccgagauugccaagcgcccuaaggugagagaccaggaagggcggaucaacuauuacuggacgcuucuggagcccggagauacaauuaucuuugaggcgaauggcaaccucauugccccucgcuaugcuuucgcccugagcagaggguuuggaucuggcaucauuaccuccaaugcucccauggacgaaugugaugccaaaugccagacaccgcaaggcgcgaucaacagcucucuuccuuuccagaaugugcaccccgucaccaucggggaguguccuaaguacgugcggagcgccaaacugcgcaugguuaccggacucagaaacauucccuccauccagucucggggccuguuuggggcuauugccggauucaucgaaggcggguggacaggaaugguggacggcugguauggcuaccaucaccagaaugagcaagggagcggauacgcugccgaucagaaguccacgcagaacgccauuaauggcaucaccaacaaagucaauagcgugaucgaaaagaugaacacacaguuuaccgcuguugggaaagaguucaauaagcuggagcgcagaauggaaaaccucaauaagaaaguggacgauggauuccuggacauuuggacauauaacgcggagcuucugguccuccuggaaaacgagcggacccuugacuuucacgauucuaaugugaagaaccuguacgaaaaagucaagucccaacucaaaaauaacgccaaggagaucggcaaugggugcuucgaguuuuaucauaaguguaacgacgaaugcauggagagcgugaaaaauggcacguacgauuaucccaaguacucugaagaguccaaacugaaccgcgagaagauugacggaguuaaacuggaaagcaugggcguguaucagauccucgcuauuuacuccacagucgccucuagccuggugcuucugguuucccucggggccaucucuuucuggaugugcagcaauggaucccugcaguguagaaucugcauuuga

SEQ ID NO: 183502 - RNA, 1698 nt, Artificial Sequence
  derived and/or modified sequence opt5 from hemagglutinin__InfluenzaA__ABB82216
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccagcucuugcucccacaacggcaagagcucuuuuuaccgcaaucugcuuuggcugaccggcaaaaacgggcucuaucccaaucuguccaagagcuacgugaacaauaaagaaaaggagguccuggugcucuggggagugcaucacccuccgaacaucggcgaucagagagcccuguaccacacagaaaacgcuuaugucuccguugugucuagccauuacucccggcgcuucacccccgagauugccaaaagaccuaaggugcgggaccaggaagggcgcaucaauuauuacuggacgcuucuggagcccggagauacaauuaucuuugaggcuaacggcaaucucauugccccuagauaugcguucgcccugagccggggguuuggaucuggcaucauuaccuccaacgcucccauggacgaaugugaugccaagugccagacaccgcaaggcgcuaucaauagcucucuuccuuuccagaacguccaccccgugaccaucggggaguguccuaaauacguucgcagcgccaagcugagaauggugaccggacuccggaauauucccuccauccagucucgcggccuguuuggggcgauugccggauucaucgaaggcggguggacaggaauggucgacggcugguauggcuaccaucaccagaacgagcaagggagcggauacgcugccgaucagaaauccacgcagaaugcuauuaacggcaucaccaauaaggugaacagcguuaucgaaaagaugaauacacaguuuaccgccguggggaaagaguucaacaaacuggagagacggauggaaaaucucaacaagaaggucgacgauggauuccuggacauuuggacauauaacgccgagcuucuggugcuccuggaaaaugagcgcacccuugacuuucacgauucuaacgucaaaaaucuguacgaaaaggugaaaucccaacucaagaacaaugcuaaagagaucggcaacgggugcuucgaguuuuaucauaaguguaaugacgaaugcauggagagcguuaagaacggcacguacgauuaucccaaauacucugaagaguccaagcugaauagagagaaaauugacggagugaagcuggaaagcaugggcgucuaucagauccucgcgauuuacuccacaguggccucuagccugguucuucuggugucccucggggcuaucucuuucuggaugugcagcaacggaucccugcagugucggaucugcauuuga

SEQ ID NO: 183503 - RNA, 1701 nt, Artificial Sequence
  derived and/or modified sequence opt5 from hemagglutinin__InfluenzaA__ABB82227
augaagaccaucauugcccugagcuacaucuucugccucacacugggccaggaccuucccgggaacgauaauuccaaagcuacgcugugucucggacaccaugccgugccuaacggcacccuggucaagacaauuaccgacgaucaaacagagguuaccaaugcgacagaacuugugcagucuagcuccaccgggaaaaucugcaacaauccgcaccggauucuggacggaauggauuguacgcucaucgacgcucugcugggcgauccccauugcgacguguuucagaacgagaccugggaucucuucgucgaaagaucuaaggccuuuagcaauuguuauccuuacgacgugcccgauuaugccucccugcgcucucuugcugccagcuccgggacacuggaguucaucaccgaaggauuuacauggaccggcguuacgcagaacggcgggagcaaugcuugcaaaagaggaccuggcucuggguucuuuucccggcucaacuggcugacaaagagcggaaauaccuaccccgugcuuaacgucacaaugccuaauaacgacaauuucgauaagcuguauauuuggggcgugcaccauccgucuaccgaccaagagcagaccucccucuacguucaggccagcgggcgcgugacagucucuacgagacggucccagcaaaccaucauucccaacaucggaagccgcccuugggugagaggccuguccucucggauuagcaucuauuggacaauugugaaacccggcgacguccugguuaucaacuccaaugggaaccucaucgcgccucgcggauacuuuaagaugagaaccggcaaaagcucuauuaugcgguccgaugcccccaucgacacauguauuagcgagugcaucaccccgaaugggucuauuccuaacgauaagcccuuccagaauaucaacaaaaucacguacggagcuuguccuaaguaugugaagcagaauacacugaaacuugccaccggcaugcgcaacgugcccgaaaagcagaccagagggcuguuuggagcuauugccggcuucaucgagaauggcugggaagggaugauugacggaugguacggcuuucggcaccaaaacagcgaggggacaggacaggcggccgaucucaaauccacccaggcugccaucgaccaaauuaauggcaagcugaaccgcaucaucgagaaaacaaaugaaaaguuccaccagauugagaaagaguucucugaagucgaagggagaauccaggaucuugagaaguauguggaggacacgaagauugaucuguggagcuacaacgcugaacuccugguugccauggagaaucagcauaccaucgaccugacagauuccgaaaugaacaaacucuuugagaagacccggagacaacugcgcgaaaacgccgaggacaugggcaauggaugcuucaaaauuuaucacaagugugacaacgcuugcaucgagagcauucggaauggcacauacgaucaugacguguauagagaugaagcgcuuaacaaucgcuuucagaucaaaggggucgagcugaagucuggauacaaggacuggauccucuggauuuccuucgccaucagcugcuuucugcuuugugugguucugcucggcuucauuaugugggcuugccagcgggggaacaucagauguaauauuugcaucuga

SEQ ID NO: 183504 - RNA, 1698 nt, Artificial Sequence
  derived and/or modified sequence opt5 from hemagglutinin__InfluenzaA__ABB83026
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccgagaaaaacggccucuaucccaaucugucuaaguccuacgcuaacaauaaagaaaaggaaguucugauucucuggggagugcaucacccuccgaacaucggggaucagagaacacuguaccacaccgagaacgccuaugucagcgugguguccucucauuacagccggcgcuucacgcccgaaauuacaaaaagaccuaagguccgggaccaggagggccgcaucaauuauuacuggacccuucuggagcccggggauacaauuaucuuugaagcuaacggaaaucucauugccccuugguaugcguucgcccuguccagaggcuuugggagcggaaucaucaccucuaacgcucccauggacgagugugaugccaagugccagaccccgcaaggcgcuauuaauuccagccuuccuuuccagaacguucaccccgugacaaucggcgaauguccuaaauacgugcggucugccaagcugcgcauggucacggggcucagaaauauucccagcauccagucccggggacuguuuggcgcgauugccggguucaucgagggaggcuggaccgggaugguggacggaugguauggcuaccaucaccagaacgaacaaggcucuggguacgcugccgaucagaaaagcacacagaaugcuaucaacggaauuaccaauaagguuaacuccgugaucgagaaaaugaauacacaguuuaccgccgucggcaaggaguucaacaaacuggaacgcagaauggagaaucucaacaagaagguggacgauggguuccuggacauuuggacguauaacgccgaacuucugguucuccuggagaaugaacggacacuugacuuucacgauagcaacgugaaaaaucuguacgagaaggucaaaucucaacucaagaacaaugcuaaagagaucggaaacggcugcuucgaauuuuaucauaaguguaauaacgagugcauggaauccgugaagaaugggaccuacgacuaucccaaauacagcgaggagucuaagcugaaccgcgagaaaauugauggcgucaagcuggaauccaugggaguguaucagauccucgcgaucuacagcaccguugccuccucucuggugcuucuggucagccucggcgcuauuuccuucuggaugugcucuaaugggagccugcaguguagaaucugcauuuga

SEQ ID NO: 183505 - RNA, 1698 nt, Artificial Sequence
  derived and/or modified sequence opt5 from hemagglutinin__InfluenzaA__ABB83127
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcgaucagagaacccuguaccacacagaaaacgcuuaugucagcgugguguccucucauuacagccggcgcuucacccccgagauuacgaaaagaccuaagguccgggaccaggaagggcgcaucaauuauuacuggacacuucuggagcccggagauaccauuaucuuugaggccaacggcaaucucauugcgccuugguaugccuucgcucuguccagaggguuuggaagcggcaucaucauuucuaacgcccccauggacgaaugugaugcuaagugccagacaccgcaaggcgccaucaauuccagccuuccuuuccagaacguucaccccgugaccauuggggaguguccuaaauacgugcggucugcgaagcugcgcauggucaccggacucagaaauauccccagcauucagucccggggccuguuuggggccaucgcuggauucaucgaaggcggguggacaggaaugguggacggcugguauggcuaccaucaccagaacgagcaagggucuggauacgccgcugaucagaaaagcacgcagaaugccauuaacggcaucaccaauaagguuaacuccgugauugaaaagaugaauacacaguuuaccgccgucgggaaagaguucaacaaacuggagcgcagaauggaaaaucucaacaagaagguggacgauggauuccuggacaucuggacauauaacgcugagcuucugguucuccuggaaaaugagcggacccuugacuuucacgauagcaacgugaaaaaucuguacgaaaaggucaaaucucaacucaagaacaaugcgaaagagauuggcaacgggugcuucgaguuuuaucauaaguguaauaacgaaugcauggaguccgugaagaauggcacguacgacuaucccaaauacagcgaagagucuaagcugaaccgcgagaaaaucgauggagucaagcuggacuccaugggcguguaucagauccucgccauuuacagcacaguugcuuccucucuggugcuucuggucagccucggggccaucuccuucuggaugugcucuaauggaagccugcaguguagaauuugcaucuga

SEQ ID NO: 183506 - RNA, 1698 nt, Artificial Sequence
  derived and/or modified sequence opt5 from hemagglutinin__InfluenzaA__ABB83138
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucuaucagcuccuucgaacgguuugagauuuuccccaaggagagcucuuggccuaaucauacggugaccggagucuccgcuagcugcucucacaacggcaaguccagcuuuuaccgcaaucugcuuuggcugacaggcaaaaacgggcucuaucccaaucugucuaaguccuacgccaacaauaaagaaaaggaggugcugauccucuggggaguucaucacccuccgaacauuggcgaucagagaacccuguaccacacagaaaacgcuuaugugagcgucguguccucucauuacagccggcgcuucacccccgagaucacgaaaagaccuaaggugcgggaccaggaagggcgcauuaauuauuacuggacacuucuggagcccggagauaccaucauuuuugaggccaacggcaaucucaucgcgccuugguaugccuucgcucuguccagaggguuuggaagcggcaucauuacaucuaacgcccccauggacgaaugugaugcuaagugccagaccccgcaaggcgccaucaauuccagccuuccuuuccagaacguccaccccguuaccauuggggaguguccuaaauacgugcggucugcgaagcugcgcauggugacaggacucagaaauauccccagcauucagucccggggccuguuuggggccaucgcuggauucaucgaaggcggguggacgggaauggucgacggcugguauggcuaccaucaccagaacgagcaagggucuggauacgccgcugaucagaaaagcacccagaaugccauuaacggcaucacaaauaaggugaacuccguuauugaaaagaugaauacccaguuuacagccguggggaaagaguucaacaaacuggagcgcagaauggaaaaucucaacaagaaggucgacgauggauuccuggacaucuggaccuauaacgcugagcuucuggugcuccuggaaaaugagcggacgcuugacuuucacgauagcaacguuaaaaaucuguacgaaaaggugaaaucucaacucaagaacaaugcgaaagagauuggcaacgggugcuucgaguuuuaucauaaguguaauaacgaaugcauggaguccgucaagaauggcacauacgacuaucccaaauacagcgaagagucuaagcugaaccgcgagaaaaucgauggagugaagcuggacuccaugggcgucuaucagauccucgccauuuacagcaccguggcuuccucucugguucuucuggugagccucggggccaucuccuucuggaugugcucuaauggaagccugcaguguagaauuugcaucuga

SEQ ID NO: 183507 - RNA, 1701 nt, Artificial Sequence
  derived and/or modified sequence opt5 from hemagglutinin__InfluenzaA__ABB86877
augaaggccauccugcucauucugcuuuacaccuucacagcuacgaacgccgacacccugugcaucggcuaucacgcgaauaacagcacagauaccguggacacaguccucgagaaaaauguuaccgugacacauuccgugaaccugcuugaagauagacacaaugggaagcuguguaaccucggaggcauugcuccccuguaccuggggaauugcaacaucgccggauggcuccugggcaauccugagugugaacuucuguuuaccgucucuagcugguccuauauuguggagacgucuaacagcgacaaugggaccugcuacccgggagauuucaucaacuaugaagaacuccgggagcagcuguccucuaugagcuccuacgaacgcuuugagaucuuccccaaagaaagcucuuggccuaaucaugagacaaacagaggcguuaccgccgcuugucccuaugccggcgcuaauuccuuuuaccggaaccuuauuuggcuggugaagaaagggaacagcuacccuaagaucaauaagucuuaugucaacaauaaagagaaggaagugcucguucuguggggcauucaccaucccccuacauccgccgaccaacagagccuguaccagaacgcggaugccuaugugucugucgaguccagcaaauacaauaagaaauucaagccggaaaucgcuacccgccccaaggugagaggacaggccgggcggaugaacuauuacuggacgcucguggagccuggagacacaauuaccuuugaagcuacaggcaaucuggucguuccccgcuaugccuucgcgaugaacagaggguccggaucuggcaucauuaucagcgauaccccugugcacgacugcaauaccacaugucaaacgcccaaaggcgccaucaacaccucccuuccguuucagaaugugcacccugucacaauuggggagugccccaaguacgugaaaagcaccaagcugcggauggcuacaggacuccgcaacaucccuucuauucaguccagaggccuguucgaggccaucgcuggguuuauugaaggaggcuggaccgggaugaucgauggaugguacggcuaucaucaccagaaugagcaaggcagcggguacgccgccgaccggaaaucuacgcagaacgcuaucgauggaauuacaaauaagguuaacagcgugaucgagaaaaugaacacccaguucaccgcggucggcaaggaguuuaaucaucuugaaaagcgcauugagaaccugaauaaaaagguggacgacggguuccucgauguuuggacauauaacgccgagcugcuggugcuccuggaaaaugagagaacccuugacuuccacgauuccaacgucaaaaaucuguacgaaaaggugcggucucagcuccgcaacaaugcuaaagagaucggaaacggcuguuuugaguucuaucacaagugcgacgauacauguauggaaagcgucagaaaugggacguacgacuaucugaaguacuccgaggaaagcaaacuuaaccgggagaagauugaaggcgugaaacuggauucugccagaaucuaccaaauccucgccauuuauuccaccguugcuagcucucuggugcugcucgucucccugggagccaucagcuuuuggaugugcuccaauggcucucuucagugccgcauuuguaucuga

SEQ ID NO: 183508 - RNA, 1701 nt, Artificial Sequence
  derived and/or modified sequence opt5 from hemagglutinin__InfluenzaA__ABB86887
augaaggccauccugcucauucugcuuuacaccuucacagcuacgaacgccgacacccugugcaucggcuaucacgcgaauaacagcacagauaccguggacacaguccucgagaaaaauguuaccgugacacauuccgugaaccugcuugaagauagacacaaugggaagcuguguaaccucggaggcauugcuccccuguaccuggggaauugcaacaucgccggauggcuccugggcaauccugagugugaacuucuguuuaccgucucuagcugguccuauauuguggagacgucuaacagcgacaaugggaccugcuacccgggagauuucaucaacuaugaggaacuccgggagcagcuguccucuaugagcuccuacgaacgcuuugagaucuuccccaaagaaagcucuuggccuaaucaugagacaaacagaggcguuaccgccgcuugucccuaugccggcgcuaauuccuuuuaccggaaccuuauuuggcuggugaagaaagggaacagcuacccuaagaucaauaagucuuaugucaacaauaaagagaaggaagugcucguucuguggggcauucaccaucccccuacauccgccgaccaacagagccuguaccagaacgcggaugccuaugugucugucgaguccagcaaauacaauaagaaauucaagccggaaaucgcuacccgccccaaggugagaggacaggccgggcggaugaacuauuacuggacgcucguggagccuggagacacaauuaccuuugaagcuacaggcaaucuggucguuccccgcuaugccuucgcgaugaaaagaggguccggaucuggcaucauuaucagcgauaccccugugcacgacugcaacaccacaugucaaacgcccaagggcgccaucaauaccucccuuccguuucagaacauucacccugugacaaucggggagugccccaaauacgucaagagcaccaaacugcggauggcuacaggacuccgcaauauuccuucuauccaguccagaggccuguucggggccauugcuggauuuaucgagggcggguggaccggaaugaucgauggcugguacggcuaucaucaccagaacgaacaagggagcggauacgccgccgaccggaagucuacgcagaaugcuauugauggcaucacaaacaaagugaauagcguuauugagaagaugaacacccaguucaccgcgguggggaaggaauuuaaccaucuugagaaacgcaucgaaaaucugaacaagaaagucgacgacggauuccucgauguguggacauauaaugccgagcugcugguucuccuggagaacgaaagaacccuugacuuccacgauuccaaugugaagaaccuguacgagaaaguccggucucagcuccgcaauaacgcuaaggaaauuggcaauggguguuuugaguucuaucacaagugcgacgauacauguauggaaagcgugagaaacggcacguacgacuaucugaaauacuccgaggagagcaaacuuaaucgggaaaagaucgagggagucaagcuggauucugccagaaucuaccaaauucucgccaucuauuccaccguggcuagcucucugguucugcucgugucccugggcgccauuagcuuuuggaugugcuccaacgggucucuucagugccgcaucuguauuuga

SEQ ID NO: 183509 - RNA, 1698 nt, Artificial Sequence
  derived and/or modified sequence opt5 from hemagglutinin__InfluenzaA__ABB86899
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccugggcauuuugccgacuacgaggaacugagagagcaacucuccucugugagcuccuucgaacgguuugagaucuuccccaaggagagcucuuggccuaaucacacgauuaccggagucuccgcuagcugcucucauaacggcaagcgcuccuuuuauagaaaucugcuuuggcugacaggcaaaaacgggcucuaccccaaucugagcaagucuuaugccaacaauaaagaaaaggaggugcugauccucuggggaguucaccacccuccgaacauuggcgaucagcggacccuguaccauacagaaaacgcuuacguguccgucgugagcucccacuauucucgcagauucacccccgagaucacgaaacggccuaaggugcgcgaccaggaagggagaauuaauuacuauuggacacuucuggagcccggagauaccaucauuuuugaggccaacggcaaucucaucgcgccuugguacgccuucgcucugagccggggguuuggauccggcaucauuacaagcaacgcccccauggacgaaugugaugcuaagugccagaccccgcaaggcgccaucaauucuucccuuccuuuccagaacguccaucccguuaccauuggggaguguccuaaauaugugcgcagcgcgaagcugagaauggugacaggacuccggaauauccccucuauucagagccgcggccuguuuggggccaucgcuggauucaucgaaggcggguggacgggaauggucgacggcugguacggcuaucaccaccagaacgagcaaggguccggauacgccgcugaucagaaaucuacccagaaugccauuaacggcaucacaaauaaggugaacagcguuauugaaaagaugaauacccaguuuacagccguggggaaagaguucuccaaacuggagagacggauggaaaaccucaauaagaaggucgacgauggauuccuggacaucuggaccuacaacgcugagcuucuggugcuccuggaaaacgagcgcacgcuugacuuucaugauagcaauguuaaaaaccuguaugaaaaggugaaaggccaacucaagaauaacgcgaaagagauugggaauggcugcuucgaguuuuaccacaaguguaacaaugaaugcauggagucugucaagaacggaacauaugacuaccccaaauauuccgaagagagcaagcugaauagagagaaaaucgauggcgugaagcuggacucuaugggggucuaccagauccucgccauuuauuccaccguggcuagcucccugauccuucugguuucucucggagccauuagcuucuggaugugcuccaacggcucucugcagugucggaucugcauuuga

SEQ ID NO: 183510 - RNA, 1701 nt, Artificial Sequence
  derived and/or modified sequence opt5 from hemagglutinin__InfluenzaA__ABB86907
augaaggccauccugcucgugcugcuuuacaccuucacaagcacgaacgcugacacccugugcauuggcuaucacgccaauaacuccacagauaccgucgacacaguucucgagaaaaaugugaccgugacacauucugucaaccugcuugaagauaagcacaaugggaaacuguguagacucggaggcaucgcgccccugcaucuggggaagugcaacauugcuggauggcuccugggcaauccugagugugaccuucugcucaccgugagcuccuggucuuacaucguugaaacgagcaacuccuauaaugggaccugcuacccgggagauuuuacaaacuaugaggaacugcgggagcagcuuucuagcguguccagcuucgagcgcuuugaaauuuuccccaaagccucuuccuggccuaaucacgagaccaacagaggcgucacagccgcuuguccccaugccggcaccaauagcuuuuaccggaaccugaucuggcucgugaagaaggggaauacguauccuaaacugucuaaguccuacguuaacaacaaaggaaaggaagugcugguccucuggggcauccaccaccccagcacaucuaccgaccaacagucccuguaccagaaugcugauacauauguguucguggggaccagcaaauacaacaagaaguuuaaaccugagauugccguccgcccgaagguuaaagaccaggcgggaagaaugaauuauuacuggacccuuguggagcccggcgauacaaucacguucgaagccaccgggaaccugguggucccucgguaugcuuuugccaugaaucgcggacauggcuccggcauuaucauuucugacacacccgugcacgauugcaacaccacaugucaaaccccuaagggggcuaucaauacgagccuccccuuccagaacguucauccggugacaauuggaaaaugcccuaaguacgucaaauccaccagacugcggauggccaccggccuucgcaauauccccagcauccagucuagagggcuguuuggagcgauugccggcuucaucgaagggggauggacaggcaugauugacggcugguauggguaccaccaccagaacggacaaggcuccggguacgcugccgaucagaagucuacccagaaugcuaucgacggaauuacaaacaaggugaauagcguuaucgagaaaaugaacacgcaguuuaccgccgugggcaaggaguucaaucaucucgaaaaacggaucgagaaccugaacaagaaagucgacgauggguuccuggacguguggacauauaaugccgagcuccugguccuucuggaaaacgagcgcacccucgauuuucacgacagcaaugugaagaaccuguacgaaaagguuagacggcaacuuaaaaauaacgcuaaggagauuggcaauggauguuucgaauuuuaucauaacugcgaugacgcguguauggaguccgugaaaaauggcacauacgauuauccuaaguacucugaggaaagccgccugaacagagaggaaaucaaugggauuaaacucgacuccacccggaucuaucagauucuggccaucuacagcacggucgcuucuuccagcgugcugcucguuucucugggagccaucuccuucuggaugugcagcaacggcucccuucagugcagaauuuguaucuga

SEQ ID NO: 183511 - RNA, 1698 nt, Artificial Sequence
  derived and/or modified sequence opt5 from hemagglutinin__InfluenzaA__ABB86917
augaaggugaaacugcucauccugcuuugcaccuucacagccacguacgcugaccccauuuguaucggcuaucacgccaacaauagcaccgauacagucgacaccguucuggagaagaacguggcggugacacauuccgucaaucuccuggaagauucucacaacgggaaacuuugccugcucaagggaauugcuccucugcagcugggcaauuguagcguggccggguggauccucggaaacccggagugcgaacugcuuauuuccaaagagucuuggagcuacaucguugaaacccccaauccugagaacggcgccuguuaucccggguacuuugcugacuaugaggaacugagagagcaacucuccucugugagcuccuucgaacgguuugagaucuucccuaaggagagcucuuggcccaaucauacagucaccggaguguccgccagcugcucucacaacggcaaguccagcuuuuaccgcaaucugcuuuggcugacgggcaaaaacgggcucuauccuaaucugucuaaguccuacgcuaacaauaaagaaaaggagguucugauucucuggggagugcaucacccgcccaacaucggcgaucagagaacccuguaccacacagaaaacgccuaugucagcgugguguccucucauuacagccggcgcuucaccccugagauuacaaaaagacccaagguccgggaccaggaagggcgcaucaauuauuacuggacccuucuggagccuggagauacgauuaucuuugaggcgaacggcaaucucauugcccccugguaugcuuucgcccuguccagaggguuuggaagcggcaucaucacaucuaacgcuccgauggacgaaugugaugccaagugccagaccccucaaggcgcgauuaauuccagccuucccuuccagaacguucacccugugacaaucggggagugucccaaauacgugcggucugccaagcugcgcauggucaccggacucagaaauauucccagcauccagucccggggccuguuuggggcuauugccggauucaucgaaggcggguggaccggaaugguggacggcugguauggcuaccaucaccagaacgagcaagggucuggauacgcugccgaucagaaaagcacacagaaugccaucaacggcauuacgaauaagguuaacuccgugaucgaaaagaugaauacccaguuuacagcugucgggaaagaguucaacaaacuggagcgcagaauggaaaaucucaacaagaagguggacgauggauuccuggacauuuggaccuauaacgcggagcuucugguucuccuggaaaaugagcggacacuugacuuucacgauagcaacgugaaaaaucuguacgaaaaggucaaaucucaacucaagaacaaugccaaagagaucggcaacgggugcuucgaguuuuaucauaaguguaauaacgaaugcauggaguccgugaagaauggcaccuacgacuauccuaaauacagcgaagagucuaagcugaaccgcgagaaaauugauggagucaagcuggacuccaugggcguguaucagauccucgcuaucuacagcacgguugccuccucucuggugcuucuggucagccucggggccauuuccuucuggaugugcucuaauggaagccugcaguguagaaucugcauuuga

SEQ ID NO: 183512 - RNA, 1698 nt, Artificial Sequence
  derived and/or modified sequence opt5 from hemagglutinin__InfluenzaA__ABB86929
augaaggugaaacugcucauccugcuuuacaccuucacagccacguaugcugacaccauuugcaucggcuaccacgccaacaauagcacagauaccgucgacacaguucuggagaagaacgugaccgugacacauuccgucaaucuccuggaagauucucacaacgggaaacuuugucugcucaagggaauugcgccccugcagcugggcaauugcagcguggcuggguggauccucggaaacccugagugugaacugcuuauuuccaaagagucuuggagcuauaucguugaaaccccgaaucccgagaacggcgccugcuacccugggcauuuugccgacuaugaggaacugagagagcaacucuccucugugagcuccuucgaacgguuugagaucuuccccaaggagagcucuuggccuaaucacacgauuaccggagucuccgcuagcuguucucauaacggcaagcgcuccuuuuacagaaaucugcuuuggcugacaggcaaaaacgggcucuaucccaaucugagcaagucuuacgccaacaauaaagaaaaggaggugcugauccucuggggaguucaccacccuccgaacauuggcgaucagcggacccuguaccauacagaaaacgcuuauguguccgucgugagcucccacuacucucgcagauucacccccgagaucacgaaacggccuaaggugcgcgaccaggaagggagaauuaauuauuacuggacacuucuggagcccggagauaccaucauuuuugaggccaacggcaaucucaucgcgccuugguaugccuucgcucugagccggggguuuggauccggcaucauuacaagcaacgcccccauggacgaaugcgaugcuaagugucagaccccgcaaggcgccaucaauucuucccuuccuuuccagaacguccaucccguuaccauuggggagugcccuaaauacgugcgcagcgcgaagcugagaauggugacaggacuccggaauauccccucuauucagagccgcggccuguuuggggccaucgcuggauucaucgaaggcggguggacgggaauggucgacggcugguauggcuaccaccaccagaacgagcaaggguccggauacgccgcugaucagaaaucuacccagaaugccauuaacggcaucacaaauaaggugaacagcguuauugaaaagaugaauacccaguuuacagccguggggaaagaguucuccaaacuggagagacggauggaaaaccucaauaagaaggucgacgauggauuccuggacaucuggaccuauaacgcugagcuucuggugcuccuggaaaacgagcgcacgcuugacuuucaugauagcaauguuaaaaaccuguacgaaaaggugaaaggccaacucaagaauaacgcgaaagagauugggaauggcuguuucgaguuuuaucacaagugcaacaaugaauguauggagucugucaagaacggaacauacgacuaucccaaauacuccgaagagagcaagcugaauagagagaaaaucgauggcgugaagcuggacucuaugggggucuaucagauccucgccauuuacuccaccguggcuagcucccugauccuucugguuucucucggagccauuagcuucuggaugugcuccaacggcucucugcagugccggaucuguauuuga

SEQ ID NO: 183513 - RNA, 1701 nt, Artificial Sequence
  derived and/or modified sequence opt5 from hemagglutinin__InfluenzaA__ABB86937
augaaggccauccugcucgugcugcuuuacaccuucacaagcacgaacgcugacacccugugcauuggcuaucacgccaauaacuccacagauaccgucgacacaguucucgagaagaaugugaccgugacacauucugucaaccugcuugaagauaagcacaaugggagacuguguaaacucggaggcaucgcgccccugcaucuggggaagugcaacauugcuggauggcuccugggcaauccugagugugaacuucuguuuaccgugagcuccuggucuuacaucguugagacgagcaacuccuauaaugggaccugcuacccgggagacuucauuaacuaugaagaacuccgggagcagcugucuagcguguccagcuuugaacgcuucgagaucuuucccaaagccucuuccuggccuaaucacgaaacaaacagaggcgucaccgccgcuuguccccaugccggcacaaauagcuucuaccggaaccuuaucuggcuggugaagaaggggaauaccuauccuaaaauuucuaaguccuacguuaacaacaaaggaaaggaggugcucguccuguggggcauccaccaccccagcacgucuaaugaucaacagucccuguaccagaacgcugacacauauguguuuguggggccuagcaaauacaauaagaaguucaaaccggagauugccacccgccccaaggucagagaucaggcgggacggaugaacuauuacuggacacucguugaaccuggcgacaccaucaccuuugaggccacagggaaucugguggugccccgcuaugcuuucgccaugaacagaggauccgaaucuggcauuaucauuagcgauacgccuguccaugacugcaauaccacaugucaaacccccaaaggcgcuaucaacacaucccuuccguuucagaaugugcacccuguuaccaucggggagugccccaaguacgugaaaagcacgcggcugcgcauggccacaggacucagaaacauuccuucuauccagucccggggccuguucggggcgauugccggauuuaucgaagagggcuggaccgggaugauugauggaugguauggcuaccaucaccagaauggccaagggagcggauacgcugccgaccagaagucuacccagaacgcuaucgauggcaucacaaauaaagucaacagcgugauugagaagaugaauacccaguucacagccguugggaaggaguucaaccaccuugagaaacgcaucgaaaaccugaauaagaaaguggacgacggauuucucgaugucuggacguauaacgccgagcugcuggugcuccuggaaaaugagagaacccuugacuuccaugauuccaacgucaagaaucuguacgagaaagugcggcgccaacucaagaacaaugcuaaggaaauuggcaacggguguuuugaguucuaucacaaaugcgacgaugcguguauggaaucuguuaagaauggcacauacgacuaucccaaauacagcgaggaauccagacugaaccgggaggagaucaauggaauuaaacuugauagcaccagaaucuaucagauccuggccauuuacucuacaguggcuuccagcucuguccuccuggugucccugggcgccaucagcuuuuggaugugcuccaacgggucucuccagugccgcauuuguaucuga

SEQ ID NO: 183514 - RNA, 1701 nt, Artificial Sequence
  derived and/or modified sequence opt5 from hemagglutinin__InfluenzaA__ABB86946
augaaggccauccugcucgugcugcuuuacaccuucacagcugccaacgcggacacgcugugcauuggcuaucacgcuaauaacagcaccgauacagucgacaccguucucgagaaaaaugugacagugacccauuccgucaaccugcuugaagauagacacaaugggaagcuguguaaacuccggggaaucgcgccccugcaucugggcaagugcaacauugccggguggcuccugggaaauccugagugugaaucucuuagcacaguguccucuuggagcuacaucguugagaccuccaacucugacaauggcacgugcuauccgggggauuuuauuaacuacgaagaacugcgcgagcagcucagcuccgugagcucuuucgaaagauuugagaucuuccccaaggcuuccagcuggccuaaucacgaaaccaaccggggaacaaccgccgcuugucccuaugccggcgccaauucuuuuuaccgcaaccugaucuggcuugucaaaaagggcaauuccuauccuaaacugaacaagagcuacgugaacaauaaagggaaggagguucucgugcuguggggcauucaucaccccucuacauccaacgagcaacagagccuguaccagaaugccgacaccuaugucuucgugggauccucuaaauacaacaagaaguuuaaaccugaaaucgcuacgagaccgaaggugcgggaucaggccgggcgcaugaauuauuacuggacacucauugagcccggagacaccaucacauucgaagcuaccggcaaccuggucguuccuagauaugccuuugcgaugaaucgggggagcggauccggcauuaucauuagcgauacccccgugcacgacugcaacacaacgugucaaaccccuaaaggcgccaucaauacaucucuucccuuccagaacgugcauccggucaccaucggggagugcccuaaguacgugaaauccacaaagcugcgcauggcuaccggacucagaaauauucccagcauccagucucggggccuguuuggggccauugcuggauucaucgaaggcggguggacgggaaugauugauggcugguauggcuaccaccaucagaacgagcaagggagcggauacgccgccgaccagaaauccacacagaaugcuaucgauggcaucaccaacaagguuaauucugugauugagaagaugaacacccaguuuacagcggucgggaaagaguucaaccaccuugagaagcgcaucgaaaaucugaacaaaaagguggacgacggauuccucgauguuuggaccuauaaugccgagcugcuggugcuccuggaaaacgagagaacacuugacuuucacgauagcaaugucaaaaaccuguacgagaaggugcggucccaacucaagaauaacgcuaaagaaauuggcaauggguguuucgaguuuuaucauaagugcgacgaugccuguauggaaagcgucaaaaacggcacguacgacuauccuaaguacucugaggaaucccgccugaauagagaggagaucgauggaauuaaacuugacagcacccggaucuaucagauccuggccauuuacucuacaguggcuuccagcuccguucuccuggugucucugggcgccaucagcuucuggaugugcuccaacgggucucuccagugcagaauuuguaucuga

SEQ ID NO: 183515 - RNA, 1701 nt, Artificial Sequence
  derived and/or modified sequence opt5 from hemagglutinin__InfluenzaA__ABB96319
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacaacccgcaccggauccuggaugggaagaauuguacccuuaucgacgcccugcucggagauccccauugcgacggcuuccagaacgagaaaugggaucuguuugucgaacgcucuaaggccuucagcaauuguuauccuuacgacgugcccgauuaugcuucccugagaucucucguugccagcuccgggacgcuggaguuuuucaacgaaggauuuaauuggaccggcgugacacaaaacggcgggagcuacgcuugcaaacggggaccugacaauucuuucuuuucccgccuuaacuggcuguauaagagcgagucuaccuaccccguccucaaugugacaaugccuaacaacgauaauuucgacaagcuguauauuuggggcguucaccauccguccaccgauaaagagcagacgaaccuuuacgugcaggccagcgggagagucacagugucuaccaagcggucccagcaaacaaucauucccaaugugggaccucgccccugggucagaggccugagcucccggaucucuauuuacuggaccaucguuaaaccuggggacgugcuccugauuaacagcaauggaaaccugaucgcgccccgcggcuauuuuaagaucagaaccggcaaauccagcauuaugcggucugacgccccgaucgggacauguuccagcgaaugcauuacgccuaauggaucuauccccaacgauaagccuuuccagaaugugaacaagauuaccuacggcgcuugucccaaauaugucaagcagaauacacucaaacuggccaccgggaugcgcaacgugcccgagaagcagacaagaggaaucuuuggcgcuaucgccggguucauugaaaauggaugggagggcaugaucgacggcugguacggguuccggcaccaaaacagcgagggaaccggccaggcggccgaucuuaaauccacgcaggcugccauugaccaaaucaaugggaagcugaaccgcguuauugagaaaacaaacgaaaaguuucaccagaucgaaaaggaguucucugaaguggagggaagaauccaggaucucgagaaauaugucgaagacaccaagauugaucuguggagcuacaaugcugagcuucugguggcccucgaaaaccagcauaccaucgaccugacagauuccgagaugaauaaacuguuugaaaagacccggagacaacuccgcgagaacgccgaggacaugggcaaugggugcuucaaaauuuaucacaagugugauaacgcuugcaucggcagcauucggaauggaacauacgaccaugacguuuacagagaugaagcgcugaacaaucgcuuucagaucaagggcguggagcuuaaaucuggguauaaggacuggauucuguggaucuccuucgccaucagcugcuuucuccugugugucgugcuucugggauucauuaugugggcuugccagaaaggcaacauccgguguaauauuugcaucuga

SEQ ID NO: 183516 - RNA, 1701 nt, Artificial Sequence
  derived and/or modified sequence opt5 from hemagglutinin__InfluenzaA__ABB96330
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacaacccgcaccggauccuggaugggaagaauuguacccuuaucgacgcccugcucggagauccccauugcgacggcuuccagaacgagaaaugggaucuguuugucgaacgcucuaaggccuucagcaauuguuauccuuacgacgugcccgauuaugcuucccugagaucucucguugccagcuccgggacgcuggaguuuuucaacgaaggauuuaauuggaccggcgugacacaaaacggcgggagcuacgcuugcaaacggggaccugacaauucuuucuuuucccgccuuaacuggcuguauaagagcgagucuaccuaccccguccucaaugugacaaugccuaacaacgauaauuucgacaagcuguauauuuggggcguucaccauccguccaccgauaaagagcagacgaaccuuuacgugcaggccagcgggagagucacagugucuaccaagcggucccagcaaacaaucauucccaaugugggaagccgcccuugggucagaggccuguccucucggaucagcauuuacuggaccaucguuaaacccggggacgugcuccugauuaacuccaauggaaaccugaucgcgccucgcggcuauuuuaagaucagaaccggcaaaagcucuauuaugcgguccgacgcccccaucgggacauguagcucugaaugcauuacgccgaauggaagcaucccuaacgaucgccccuuccagaaugugaacaagauuaccuacggcgcuuguccuaaguaugucaaacagaauacacucaagcuggccaccgggaugagaaacgugcccgagaaacagacacggggaaucuuuggcgcuaucgccggguucauugaaaauggaugggagggcaugguugacggcugguacggguuccgccaccaaaacuccgagggaaccggccaggcggccgaucuuaagucuacgcaggcugccaucgaccaaauuaaugggaaacugaacagagugaucgaaaagacaaacgagaaauuucaccagauugaaaaggaguucagcgaagucgagggacggauccagaaucucgagaaguauguggaagauaccaaaaucgaccugugguccuacaacgcugagcuucugguugcccucgaaaaucagcauaccauugaucugacagacagcgagaugaacaagcuguuugagaaaaccagacgccaacuccgggaaaaugccgaggauaugggcaacgggugcuucaagaucuaucacaaaugugacaaugcuugcauuggcucuaucagaaacggaacauacgaucaugacguguaccgcgacgaagcgcugaauaaccgguuucagauuaagggcgucgagcuuaaguccggguauaaagauuggauccuguggauuagcuucgccaucucuugcuuucuccugugugugguccuucugggauucaucaugugggcuugccagaagggcaauauuagauguaacaucugcauuuga

SEQ ID NO: 183517 - RNA, 1701 nt, Artificial Sequence
  derived and/or modified sequence opt5 from hemagglutinin__InfluenzaA__ABB96341
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacaacccgcaccggauccuggaugggaagaauuguacccuuaucgacgcccugcucggagauccccauugcgacggcuuccagaacgagaaaugggaucuguuugucgaacgcucuaaggccuucagcaauuguuauccuuacgacgugcccgauuaugcuucccugagaucucucguugccagcuccgggacgcuggaguuuuucaacgaaggauuuaauuggaccggcgugacacaaaacggcgggagcuacgcuugcaaaaagggaccugacaauucuuucuuuucccggcuuaacuggcuguauaagagcgagucuaccuaccccguccucaaugugacaaugccuaacaacgauaauuucgacaaacuguauauuuggggcguucaccauccguccaccgauaaggagcagacgaaccuuuacgugcaggccagcgggcgcgucacagugucuaccaaaagaucccagcaaacaaucauucccaaugugggaagccggccuuggguccgcggccuguccucuagaaucagcauuuacuggaccaucguuaagcccggggacgugcuccugauuaacuccaauggaaaccugaucgcgccucggggcuauuuuaaaauccgcaccggcaagagcucuauuaugagauccgacgcccccaucgggacauguagcucugaaugcauuacgccgaauggaagcaucccuaacgauaagcccuuccagaaugugaacaaaauuaccuacggcgcuuguccuaaguaugucaaacagaauacacucaagcuggccaccgggaugcggaacgugcccgagaaacagacacgcggaaucuuuggcgcuaucgccggguucauugaaaauggaugggagggcaugaucgacggcugguacggguucagacaccaaaacuccgagggaaccggccaggcggccgaucuuaagucuacgcaggcugccauugaccaaaucaaugggaaacugaaccggguuauugaaaagacaaacgagaaguuucaccagaucgaaaaagaguucagcgaaguggagggacgcauccaggaucucgagaaguaugucgaagacaccaaaauugaucugugguccuacaaugcugagcuucugguggcccucgaaaaccagcauaccaucgaccugacagauagcgagaugaauaagcuguuugagaaaaccagacggcaacucagagaaaacgccgaggacaugggcaaugggugcuucaagauuuaucacaagugugauaacgcuugcaucggcucuauucgcaauggaacauacgaccaugacguuuaccgggaugaagcgcugaacaauagauuucagaucaaaggcguggagcuuaaguccggguauaaagacuggauucuguggaucagcuucgccaucucuugcuuucuccugugugucgugcuucugggauucauuaugugggcuugccagaagggcaacauccgcuguaauauuugcaucuga

SEQ ID NO: 183518 - RNA, 1701 nt, Artificial Sequence
  derived and/or modified sequence opt5 from hemagglutinin__InfluenzaA__ABB96395
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacucuccgcaccggauccuggaugggaagaacuguacccuuauggacgcccugcucggagauccccauugcgacggcuuccagaaugagaaaugggaucuguuugucgaacgcagcaaggccuucuccaacuguuauccuuacgacgugcccgauuaugcuucucugagaagccucguugccuccagcgggacgcuggaguuuaucaaugaaggauucaacuggaccggcgugacacaaaauggcgggucuuacgcuugcaaacggggaccugacaacuccuuuuucagccgccuuaauuggcuguauaagucugaguccaccuaccccguccucaacgugacaaugccuaauaacgauaacuuugacaagcuguauauuuggggcguucaccauccgagcaccgauaaagagcagacgaaucuuuacgugcaggccucugggagagucacaguguccaccaagcggagccagcaaacaaucauucccaacgugggaucccgcccuugggucagaggccugucuagccggaucuccauuuacuggaccaucguuaaacccggggacauucuccugaucaauagcaacggaaaucugaucgcgccucgcggcuauuucaagauuagaaccggcaaaucuuccaucaugcggagcgacgcccccauugggacauguucuagcgaaugcaucacgccgaacggauccauuccuaaugauaagcccuuucagaacgugaauaagaucaccuacggcgcuuguccuaaauaugugaagcagaacacacucaaacuggccaccgggaugcgcaauguccccgagaagcagacaagaggaaucuucggcgcuauugccggguuuaucgaaaacggaugggagggcaugauugacggcugguacggguuccggcaccaaaauucugagggaaccggccaggcggccgaucuuaaaagcacgcaggcugccaucgaccaaauuaacgggaagcugaaucgcgugaucgaaagaacaaacgagaaauuccaccagaucgaaaaggaguuuuccgaaguugagggacggauucaggaucucgagaaguauguggaagacaccaaaaucgaucuguggagcuacaacgcugagcuucuggucgcccucgaaaaucagcauaccauugaccugacagauucugagaugaacaagcuguucgagaaaaccagacgccaacuccgggaaaaugccgaggacaugggcaacgggugcuuuaagaucuaucacaaaugugauaaugcuugcauuggcuccaucagaaacggaacauacgaccaugacguguaccgcgaugaagcgcugaauaaccgguuccagauuaagggcguugagcuuaagagcggguauaaagacuggauccuguggaucucuuuugccauuuccugcuuccuccugugugugguccuucugggauuuaucaugugggcuugccagaagggcaauauuagauguaacaucugcauuuga

SEQ ID NO: 183519 - RNA, 1698 nt, Artificial Sequence
  derived and/or modified sequence opt5 from hemagglutinin__InfluenzaA__ABB96487
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaaaagagcucuuggccuaaucauacggucaccggaguguccgcuagcugcucucacgauggcaaguccagcuuuuaccgcaaccugcuuuggcugacaggcaagaaugggcucuaucccaaccugucuaaauccuacgccaauaacaaggagaaagaaguucugauucucuggggagugcaucacccuccgaauaucggcgaccagagaacccuguaccacacagagaacgcuuaugucagcgugguguccucucauuacagccggcgcuucacccccgaaauuacgaagagaccuaagguccgggaucaggaggggcgcaucaacuauuacuggacacuucuggaacccggagacaccauuaucuuugaggccaauggcaaccucauugcgccuugguaugccuucgcucuguccagaggguuuggaagcggcaucaucacaucuaaugcccccauggaugagugugacgcuaaaugccagaccccgcaaggcgccauuaacuccagccuuccuuuccagaauguucaccccgugaccaucggggaauguccuaaguacgugcggucugcgaaacugcgcauggucacaggacucagaaacauucccagcauccagucccggggccuguuuggggccauugcuggauucaucgagggcggguggacgggaaugguggauggcugguauggcuaccaucaccagaaugaacaagggucuggauacgccgcugaccaaaagagcacccagaacgccaucaauggcauuacaaacaaaguuaauuccgugaucgagaagaugaacacccaguuuacagccgucgggaaagaguucaauaagcuggaacgcagaauggagaaccucaauaagaaaguggaugacggauuccuggacauuuggaccuauaacgcugaacuucugguucuccuggagaacgaacggacgcuugauuuucacgacagcaaugugaagaaccuguacgagaaagucaagucucagcucaaaaauaacgcgaaggaaaucggcaaugggugcuucgaguuuuaucauaaguguaacaaugagugcauggaauccgugaaaaacggcacauacgauuaucccaaguacagcgaggaaucuaaacugaaucgcgagaagauugacggagucaaacuggauuccaugggcguguaucagauccucgccaucuacagcaccguugcuuccucucuggugcuucuggucagccucggggccauuuccuucuggaugugcucuaacggaagccugcaguguagaaucugcauuuga

SEQ ID NO: 183520 - RNA, 1701 nt, Artificial Sequence
  derived and/or modified sequence opt5 from hemagglutinin__InfluenzaA__ABB96520
augaagaccaucauugcccugagcuacaucuucugccucgcucugggccaggaccuucccgggaacggaaauuccacagccacgcugugucucggccaccaugcggugccuaacgggacccuggucaaaacaauuaccgaugaccaaaucgagguuacaaaugcuaccgaacuugugcagucuagcuccacaggaaagauuugcaacaauccgcacagaauccuggauggcaucgacuguacccucauugaugcccugcugggggacccccauugcgauguguuucagaacgagacgugggaccucuucgucgaacggucuaaagccuuuagcaauuguuauccuuacgaugugcccgacuaugcuucccugcgcucucuuguugccagcuccggaacccuggaguucaucacagaaggcuuuaccuggacaggcgugacccagaacgggggaagcaaugcuugcaagagaggcccugggucuggauucuuuucccggcucaacuggcugacgaaaagcggcucuacauaccccguccuuaaugugaccaugccuaacaaugauaacuucgacaagcuguauauuuggggaguucaccauccguccacagaucaagagcagaccagccucuacgugcaggccucugggcgcgucaccguguccacaagacggagccagcaaacgaucauucccaauaucggcucccgcccuugggugagaggccugucuagccggauuuccaucuauuggaccaucgucaagcccggggacguucuggugauuaacagcaacggaaaucucaucgcgccucgcggcuacuuuaaaaugagaacagggaagucuuccauuaugcggagcgacgcccccaucgauaccuguauuucugagugcaucacaccgaacggaagcaucccuaaugacaaacccuuccagaacgugaauaagauuaccuacggcgcuuguccuaaauaugucaagcagaagacgcugaaacuugccacagggaugcgcaacauccccgaaaagaaaaccagaggaauuuuuggcgcuaucgccggcuucauugagaaugggugggaaggaaugaucgauggcugguacggguuucggcaccagaacuccgagggaaccggccaagcggccgaccugaagucuacacaggcugccaucgaucagauuaaugggaaacucaaccgcgugaucgagaagaccaaugaaaaauuccaccaaauugagaaggaguucagcgaaguugaaggcagaauccaggaccuggagaaguauguggaggauacaaaaauugaccuuugguccuacaacgcugaacugcucgucgcccuggagaaucagcauacgaucgaucugaccgacagcgaaaugaacaagcucuuugagaaaacacggagacagcugcgcgaaaaugccgaggauaugggaaacggcugcuucaagauuuaucacaaaugugacaacgcuugcaucgagucuauccggaaugggaccuacgaccaugauguguauagagacgaagcgcuuaacaaucgcuuucaaauuaagggaguugagcugaaguccggcuacaaagauuggauccucuggauuagcuucgccaucucuugcuuucugcuuugugugguccugcucggguucauuaugugggcuugccagcggggaaacaucagauguaauaucugcauuuga

SEQ ID NO: 183521 - RNA, 1701 nt, Artificial Sequence
  derived and/or modified sequence opt5 from hemagglutinin__InfluenzaA__ABB96531
augaagaccaucauugcccugagcuacauccucugccugguguccgcucagaaaauucccggcaacgacucuagcacagccacgcuuugucuggggcaccaugcggucccuaauggaacccucguuaagacaaucaccaacgaucaaauugaggugacaaaugcuaccgaacuggugcaguccucuagcacaggcagaaucugcgacuccccgcaccggauccuugauggggagaacuguacccugauugacgcccuccugggagauccccauugcgacggcuuccagaauaaagaaugggaucuguuugucgagcgcucuaaggccuauagcaacuguuacccuuaugacgugcccgauuacgcuucccucagaagccugguugccucuuccgggacgcuugaauuuaauaacgagagcuucaauuggaccggaguggcucagaacggcacaucuuaugccugcaaacggcgcuccaucaagagcuucuuuucuagacugaauuggcuccaccaacugaaguacaaauauccugcgcuuaacgucaccaugcccaauaacgacaaguucgauaaacuguacauuuggggcgugcaucacccuuccacagacagcgaucagaccucccucuacgcccaggcuucugggcggguuacggugagcacaaagcgcucccagcaaaccgucaucccgaauauuggaagcagacccugggugcggggcgugucuucccgcaucagcauuuauuggacaaucgucaaaccuggggacauccugcugauuaacucuaccggaaaccucaucgcccccagaggcuacuuuaagauucggagcgggaaguccucuaucaugcgcagcgacgcuccuauuggaaaauguaauuccgagugcaucacccccaacggcagcaucccgaaugauaagccuuuccagaacguuaauagaauuacauauggcgccuguccccgguacgugaaacagaacacgcugaaacuugcgaccgggaugcgcaaugugccugaaaagcagacaagaggaaucuuuggcgccauugcuggguucaucgagaacggaugggaaggcauggucgacgggugguauggauuucggcaccaaaauucugagggcaccggccaggccgcugaucugaaguccacacaggccgccauuaaccaaaucaaugggaaacucaacagacugaucgagaagaccaaugaaaaguuccaucagauugagaaagaauuuagcgagguggaaggacgcauccaggaccuugagaaguacguugaggauacgaaaauugaccuguggucuuauaacgcugaacuccugguggcgcuggagaaucagcacacaaucgaucucaccgacuccgaaaugaacaagcuguucgagcggaccagaaaacaacuucgcgaaaacgccgaggauaugggcaaugggugcuucaagauuuaccauaagugugacaacgcuugcaucggaagcauucggaauggcacauacgaucacgacgucuauagagacgaggcccugaacaaucgcuuucagaucaaagggguggaacucaaguccggcuacaaagauuggauccuguggauuucuuucgccaucagcugcuuucuucuguguguugugcuccugggauucauuaugugggcuugccagaagggcaacauccgguguaauauuugcaucuga

SEQ ID NO: 183522 - RNA, 1701 nt, Artificial Sequence
  derived and/or modified sequence opt5 from hemagglutinin__InfluenzaA__ABC02234
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccuaugccugcaaacggcgcagcauuaagucuuucuucuccagacucaacuggcugcaccaacuuaaguacaaauauccugcgcugaaugucaccaugcccaacaaugacaaguuugauaaacucuacaucuggggcgugcaucacccuagcacagacucugaucagaccucccuguacgcccaggcuagcgggcggguuacgguguccacaaagauuucucagcaaaccgucaucccgaacauuggaagccgccccugggugagaggcguguccagccggaucucuauuuauuggacaaucgucaaaccuggggacauccugcucauuaacuccaccggaaaucugaucgcuccccgcggcuacuucaagauuagaagcgggaagucuagcaucaugcgguccgacgccccuauuggaaaauguaacucugagugcaucacccccaauggcagcaucccgaacgauaagccuuuucagaauguuaaccgcauuacauauggcgccugucccagauacgugaaacagaauacgcuuaagcuggcgaccgggaugcggaacgugccugaaaaacagacacgcggaaucuucggcgccauugcuggguuuaucgagaauggaugggaaggcauggucgacgggugguauggauucagacaccaaaacuccgagggcaccggccaggccgcugaucucaagagcacacaggccgccauuaaucaaaucaacgggaaacugaaucggcuuaucgagaagaccaacgaaaaguuucaucagauugagaaagaauuuucugagguggaaggaagaauccaggaccuggagaaguacguugaggauacgaaaauugaccucugguccuauaaugcugaacugcugguggcgcucgagaaccagcacacaaucgaucugaccgacagcgaaaugaacaaacuuuucgagcgcacccggaagcaacugagagaaaaugccgaggauaugggcaacgggugcuuuaagauuuaccauaagugugacaaugcuugcaucggaucuauucgcaacggcacauacgaucacgacgucuaucgggacgaggcccucaauaacagauuccagaucaaagggguggaacugaaguccggcuacaaagauuggauccuuuggauuagcuuugccauguccugcuuccuguuuuguguugugcuccugggauucaucaugugggcuugccagaagggcaauauucgcuguaacaucugcauuuga

SEQ ID NO: 183523 - RNA, 1701 nt, Artificial Sequence
  derived and/or modified sequence opt5 from hemagglutinin__InfluenzaA__ABC02255
augaagaccaucauugcccugagcuacaucuucugccucgugcuggcucaggaccuucccggcaacgauaauuccacagccacgcugugucucgggcaccaugcggucccuaacggaacccugguuaaaacaauuaccaaugaccaaaucgaggugacaaacgcuaccgaacuugugcagucuagcuccacaggcaagauuugcaauaacccgcacagaauccuggaugggaucaauuguacccucauugacgcccugcugggagauccccauugcgacggcuuucagaacgagaaaugggaucucuucgucgaacggucuaaggccuuuagcaauuguuauccuuacgacgugcccgauuaugcuucccugcgcucucuuguugccagcuccgggacgcuggaguucaucaacgaaggauuuaauuggaccggcgugacacagaacggcgggagcaaugcuugcaaaagaggaccugacucuggcuucuuuucccggcucaacuggcuguacaagagcgggucuaccuaucccguccuuaaugugacaaugccuaacaacgauaauuucgacaagcuguacauuuggggaguucaccauccguccaccgaucaagagcagacgaaccucuaugugcaggccagcggccgcgucacagugucuaccaaaagaucccagcaaacaaucauucccaauguggggagccggccuuggguccgcggacuguccucuagaaucagcauuuacuggaccaucguuaagcccggcgacauccuggugauuaacuccaauggcaaccucaucgcgccucgggggcacuuuaaaaugcgcaccggaaagagcucuauuaugagauccgacgcccccaucggcacauguagcucugagugcauuacgccgaaugggagcaucccuaacgauaaacccuuccagaaugugaacaagaucaccuacggagcuuguccuaaguaugucaaacagaauacacugaaacuugccaccggcaugcggaacgugcccgaaaagcagacacgcgggauuuuuggagcuaucgccggcuucauugagaauggcugggaagggaugaucgacggaugguacggcuuuagacaccaaaacuccgaggggaccggacaggcggccgaucugaagucuacgcaggcugccauugaccaaaucaauggcaaacucaaccggguuaucgagaagacaaacgaaaaauuccaucagauugagaaggaguucagcgaaguggaagggcgcauccaggaucuggagaaguaugucgaggacaccaaaauugaucuuugguccuacaaugcugaacugcucguggcccuggagaaccagcacaccaucgaccugacagauagcgaaaugaauaagcucuuugagaaaaccagacggcaacugagagaaaacgccgaggacaugggcaauggaugcuucaagauuuaucauaaaugugauaacgcuugcaucggcucuauucgcaaugggacauacgaccacgacguuuaucgggaugaggcgcuuaacaauagauuucagaucaagggaguggaacugaaguccggcuacaaagacuggauccucuggauuagcuucgccaucucuugcuuucugcuuugugucgugcugcucggguucauuaugugggcuugccagaagggaaacauccgcuguaauauuugcaucuga

SEQ ID NO: 183524 - RNA, 1701 nt, Artificial Sequence
  derived and/or modified sequence opt5 from hemagglutinin__InfluenzaA__ABC02266
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcagagcuugcaaacggggaccugauaacggcuuuuucucucgccugaauuggcucuacaaguccgggagcaccuaucccguccaaaacgugacaaugccuaauaacgacaacucugauaagcuguacauuuggggaguucaccauccguccaccgacaaagagcagacggaccuuuaugugcaggccagcggcaaggucacagugucuaccaaaagaucccagcaaacagugauccccaaugucgggagccggccuuggguucgcggacuguccucuagagugagcauuuacuggaccaucgugaagcccggcgauauucucgucaucaacuccaauggcaaccugaucgcgccucggggguacuuuaaaaugcgcaccggaaagagcucuauuaugagauccgacgcccccaucggcacauguagcucugagugcauuacgccgaaugggagcaucccuaacgauaagcccuuccagaaugugaacaaaauuaccuauggagcuuguccuaaguacguuaaacagaauacacugaagcucgccaccggcaugcggaacgugcccgaaaaacagacacgcgggaucuuuggagcuaucgccggcuucauugagaauggcugggaagggaugaucgacggaugguauggcuuuagacaccaaaacuccgaggggaccggacaggcggccgaucugaagucuacgcaggcugccauugaccaaaucaauggcaaacuuaaccgggucauugagaagacaaaugaaaaguuccaccagaucgagaaagaguucagcgaaguggaagggcgcauccaggaucuggagaaguacguugaggacaccaaaauugaucucugguccuauaacgcugaacugcuuguggcccuggagaaccagcauaccaucgaccucacagauagcgaaaugaauaagcuguuugagaaaaccagacggcaacugagagaaaacgccgaggacaugggcaauggaugcuucaagauuuaccacaagugugacaacgcuugcaucggcucuauucgcaaugggacauaugaucaugacgucuaccgggaugaggcgcucaacaauagauuucagaucaaaggaguggaacugaaguccggcuacaaagacuggauucuuuggaucagcuucgccaucucuugcuuucugcucugugucgugcugcuuggguucauuaugugggcuugccagaagggaaacauccgcuguaauauuugcaucuga

SEQ ID NO: 183525 - RNA, 1701 nt, Artificial Sequence
  derived and/or modified sequence opt5 from hemagglutinin__InfluenzaA__ABC02288
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggcgcagcaucaagucuuucuucuccagacugaacuggcuccaccaacugaaguacaaauauccugcgcuuaaugucaccaugcccaacaaugacaaguuugauaaacuguacauuuggggcgugcaucacccuagcacagacucugaucagaccucccucuacgcccaggcuagcgggcggguuacgguguccacaaagcgcucucagcaaaccgucaucccgaacauuggaagcagacccugggugcggggcguguccagccgcaucucuauuuauuggacaaucgucaaaccuggggacauccugcugauuaacuccaccggaaaucucaucgcccccagaggcuacuucaagauucggagcgggaagucuagcaucaugcgcuccgacgcuccuauuggaaaauguaacucugagugcaucacccccaauggcagcaucccgaacgauaagccuuuucagaauguuaacagaauuacauauggcgccuguccccgguacgugaaacagaauacgcugaagcuggcgaccgggaugcgcaacgugccugaaaaacagacaagaggaaucuucggcgccauugcuggguuuaucgagaauggaugggaaggcauggucgacgggugguauggauuccggcaccaaaacuccgagggcaccggccaggccgcugaucuuaagagcacacaggccgccauuaaucaaaucaacgggaaacucaauagacugaucgagaagaccaacgaaaaguuucaucagauugagaaagaauuuucugagguggaaggacgcauccaggaccuugagaaguacguugaggauacgaaaauugaccugugguccuauaaugcugaacuccugguggcgcuggagaaccagcacacaaucgaucucaccgacagcgaaaugaacaagcuguucgagcggaccagaaaacaacuucgcgaaaaugccgaggauaugggcaacgggugcuuuaagauuuaccauaagugugacaaugcuugcaucggaucuauucggaacggcacauacgaucacgacgucuauagagacgaggcccugaauaaccgcuuccagaucaaagggguggaacucaaguccggccacaaagauuggauccuguggauuagcuuugccaucuccugcuuccuucuguguguugugcuccugggauuuauuaugugggcuugccagaagggcaauauccgguguaacauuugcaucuga

SEQ ID NO: 183526 - RNA, 1701 nt, Artificial Sequence; identical to SEQ ID NO: 183494
  derived and/or modified sequence opt5 from hemagglutinin__InfluenzaA__ABC02299

SEQ ID NO: 183527 - RNA, 1701 nt, Artificial Sequence; identical to SEQ ID NO: 183518
  derived and/or modified sequence opt5 from hemagglutinin__InfluenzaA__ABC02310

SEQ ID NO: 183528 - RNA, 1701 nt, Artificial Sequence; identical to SEQ ID NO: 183523
  derived and/or modified sequence opt5 from hemagglutinin__InfluenzaA__ABC02321

SEQ ID NO: 183529 - RNA, 1701 nt, Artificial Sequence; identical to SEQ ID NO: 183329
  derived and/or modified sequence opt5 from hemagglutinin__InfluenzaA__ABC02332

SEQ ID NO: 183530 - RNA, 1701 nt, Artificial Sequence
  derived and/or modified sequence opt5 from hemagglutinin__InfluenzaA__ABC39805
augaagaccaucauugcccugagcuacauccucugccugguguucgcucagaaccuucccggcaaugacaacuccacagccacgcugugucucgggcaccaugcggucccuaauggaacccugguuaaaacaauuaccaacgaucaaaucgaggugacaaaugcuaccgaacuugugcagucuagcuccgccggcagaauuugcgacucuccgcaccggauccuggaugggaagaacuguacacucaucgacgcccugcugggagauccccauugcgacggcuuucagaaugagaaaugggaucucuucgucgaacgcagcaaggcuuuuuccaacuguuauccuuacgacgugcaggauuaugccucucugagaagccuuguugcuuccagcgggacccuggaguucauuaaugaaggauuuaacuggacgggcgugacccaaucuggcggguccuacgccugcaaacggggaagcggcaauucuuucuuuucccgccucaacuggcuguauaagagcgagucuaaguaccccgcgcuuaaugucacaaugccuaacaaugggaacuucgacaaacuguauaucuggggagugcaccaucccuccaccgauaaggagcagacaaaccucuacguuagagccagcggccgggugaccgucuccacgaaacgcucucagcagacagugauuccuaauaucgggccgagacccugggugcggggacugagcucccgcauuagcaucuacuggaccauugucaagccuggcgacauccugcucaucaacucuuccggcaaucugauugcucccagaggguauuuuaaaauccggacaggaaagagcucuauuaugcgcagcgaugccccuaucggcaccuguuccucugaaugcauuacccccaacgggagcaucccgaaugacaagccuuuccaaaacguuaauaaaaucacauacggagcuugucccaaguaugugaaacagaacacgcuuaagcuggccaccggcaugagaaauauuccugagaaacagacacgggggaucuuuggagcgauugccggcuucaucgaaaacggcugggaggggaugguggacggaugguacggcuuucgccaccaaaauuccgaggggaccggacaggcugccgaucucaagagcacacaggcugccauugaccagaucaacggcaaacugaauagagucaucgaaaagaccaacgagaaguuccaccaaauugaaaaagaguucucugaaguggaggggcggauccaggaucuugagaaguauguugaagacacgaaaauugaucugugguccuacaaugccgagcuccugguggcucuggaaaaccagcauacaaucgaccucaccgauagcgagaugaacaagcuguuugagaaaaccagacgccagcuucgggaaaaugcggaggacaugggcaacggaugcuucaagauuuaucacaagugugauaaugccugcaucggcucuauuagaaacgggacauacgaccaugaugucuaccgcgacgaagcucugaauaaccgguuucaaaucaaaggaguggagcucaaguccggcuauaaagacuggauccuguggauuagcuucgccaucuccugcuuucuucuguguguugugcuccugggguucauuaugugggccugccagaagggaaauaucagauguaacauuugcaucuga

SEQ ID NO: 183531 - RNA, 1698 nt, Artificial Sequence
  derived and/or modified sequence opt5 from hemagglutinin__InfluenzaA__ABC40522
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuacaaaaaucugcuuuggcugacaggcaagaacgggcucuaucccaaucugucuaaauccuacgccaacaauaaggaaaaagagguucugauucucuggggagugcaucacccuccgaacaucggcgaucagcgcacccuguaccacacagaaaacgcuuaugucagcgugguguccucucauuacagcagacgguucacccccgagauuacgaagcgcccuaaggucagagaccaggaagggcggaucaauuauuacuggacacuucuggagcccggagauaccauuaucuuugaggccaacggcaaucucauugcgccuugguaugccuucgcucugucccgcggguuuggaagcggcaucaucacaucuaacgcccccauggacgaaugugaugcuaaaugccagaccccgcaaggcgccauuaauuccagccuuccuuuccagaacguucaccccgugaccaucggggaguguccuaaguacgugagaucugcgaaacugcggauggucacaggacuccgcaauauucccagcauccaguccagaggccuguuuggggccauugcuggauucaucgaaggcggguggacgggaaugguggacggcugguauggcuaccaucaccagaacgagcaagggucuggauacgccgcugaucaaaagagcacccagaaugccaucaacggcauuacaaauaaaguuaacuccgugaucgaaaagaugaauacccaguuuacagccgucgggaaagaguucaacaagcuggagcggcgcauggaaaaucucaacaagaaaguggacgauggauuccuggacauuuggaccuauaacgcugagcuucugguucuccuggaaaaugagagaacgcuugacuuucacgauagcaacgugaagaaucuguacgaaaaagucaagucucagcucaaaaacaaugcgaaggagaucggcaacgggugcuucgaguuuuaucauaaguguaauaacgaaugcauggaguccgugaaaaauggcacauacgacuaucccaaguacagcgaagagucuaaacugaaccgggagaagauugauggagucaaacuggacuccaugggcguguaucagauccucgccaucuacagcaccguugcuuccucucuggugcuucuggucagccucggggccauuuccuucuggaugugcucuaauggaagccugcagugucgcaucugcauuuga

SEQ ID NO: 183532 - RNA, 1698 nt, Artificial Sequence; identical to SEQ ID NO: 183320
  derived and/or modified sequence opt5 from hemagglutinin__InfluenzaA__ABC40533

SEQ ID NO: 183533 - RNA, 1701 nt, Artificial Sequence
  derived and/or modified sequence opt5 from hemagglutinin__InfluenzaA__ABC40555
augaagaccaucauugcccugagcuacaucuucugccucguguuugcucagaaccugcccagaaaugacaaauccacagccacgcuuugucugggccaccaugcggucccuaacgggacccucguuaagacaauuaccaaugaucaaaucgaggugacaaacgcuaccgaacuggugcagucuagcuccacaggacggauuugcgacucuccgcaccgcauccuugauggcaaaaauuguacccuggucgacgcccuccugggggauccccauugcgacggauuccagaacgagaagugggaucuguuuguggaaagaagcaaagccuucuccaauuguuauccuuacgacguucccgauuaugcuucucuccggagccugguggccuccagcggcacgcuugaguuuaucaacgaaucuuucaauuggaccggggucacacaguccggaggcagcuacgcuugcaagcgcggcucugacaacuccuuuuucagcagacugaauuggcucuaugagucugaguccaaguacccugugcugaacguuaccaugcccaauaacgggaauuuugauaaacuuuauauuuggggagugcaccauccuagcacagacaaggaacaaaccaaccuguacguccgggccuccggccgcgugacggugucuacaaaaagaagccagcagaccaucauuccgaacaucgggucccggcccuggguccgcggacucagcucuagaauuuccaucuacuggacaauuguuaagccuggcgauauccugcugaucaauagcaacgggaaucucauugcgccccggggauauuucaaaauccgcaccggcaagucuagcauuaugagauccgacgccccuaucggcaccuguucuagcgagugcauuacacccaacggguccaucccgaaugacaagccuuuucagaacgugaauaaaaucacguacggagcuugucccaaguaugugaaacaaaacacccugaagcuggccacaggcaugcggaaugucccugaaaaacagacccgcgggauuuucggagcuaucgccggcuuuauugagaacgggugggagggaaugguggauggcugguacggcuucagacaccagaauagcgaagggacaggacaggcggccgaccugaagucuacccaagcugccaucgaucagauuaacggcaaacucaaucggguuaucgagaagacgaacgaaaaguuccaccagaucgagaaagaauuuuccgagguggaggggcgcauucaagaccuggaaaaguaugucgaggauacaaaaaucgaccuuuggagcuacaaugcugaacugcucguggcccuggagaaccagcauaccauugaucugaccgacucugaaaugaacaaacucuucgagaagacaagacggcagcugagagagaaugccgaagauaugggaaacggcugcuuuaagaucuaucacaagugugacaaugcuugcauuggguccauccgcaacggcaccuacgaucaugacguuuaccgggacgaggcgcuuaauaacagauuccagauuaaaggaguggaacuuaagagcggcuauaaagauuggauccucuggaucuccuuugccauuucuugcuuccugcuuugugucgugcugcucggguuuaucaugugggcuugccaaaagggaaauauucgcuguaacaucugcauuuga

SEQ ID NO: 183534 - RNA, 1701 nt, Artificial Sequence
  derived and/or modified sequence opt5 from hemagglutinin__InfluenzaA__ABC40608
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggauggggagaauuguacccucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacgcuggaauuuaacaaugagucuuucaacuggaccggaguggcucagaauggcacauccagcgccugcaaacggcgcucuauuaaguccuuuuucagcagacucaacuggcugcaccaacuuaaguauaaauacccugcgcugaaugucaccaugcccaacaaugacaaguuugauaaacucuauaucuggggcgugcaucacccuucuacagacuccgaucagaccagccuguacgcccaggcuuccgggcggguuacggugucuacacgcagaagccagcaaaccgucauuccgaacaucggaucccggcccugggugcgcggcgugagcucuagaauuuccaucuacuggacaauugucaagccuggggacauccugcucaucaacagcaccggaaaucugauugcuccccggggcuauuucaaaauccgcucuggaaagagcuccauuaugagaucugacgccccuaucgggaaguguaacagcgagugcauuacccccaauggcuccaucccgaacgauaaaccuuuucagagcguuaaucggaucacauacggcgccuguccccgcuaugugaagcagaacacgcuuaaacuggcgaccgggaugagaaaugugccugaaaagcagacacggggaauuuucggcgccaucgcuggguuuauugagaacggaugggaaggcauggucgacgggugguacggauucagacaccaaaauucugagggcaccggccaggccgcugaucucaaauccacacaggccgccaucaaccaaauuaaugggaagcugaaccgccuuaucgagaaaaccaaugaaaaguuucaucagaucgagaaggaguucagcgaaguggaaggacggauucaggaccuggagaaauauguugaggauacgaagaucgaccucuggucuuacaacgcugaacugcugguggcgcucgagaaucagcacacaauugaucugaccgacuccgaaaugaacaaacuuuucgagagaacccgcaagcaacugcgggaaaacgccgaggauaugggcaaugggugcuuuaaaaucuaucauaagugugacaacgcuugcauuggaagcaucagaaauggcacauacgaucacgacgucuaccgcgacgaggcccucaacaaucgguuccagauuaaggggguggaacugaaauccggcuauaaggauuggauccuuuggaucucuuuugccauuagcugcuuccugcucuguguugugcugcugggauuuaucaugugggcuugccagaaaggcaacauuagauguaauaucugcauuuga

SEQ ID NO: 183535 - RNA, 1701 nt, Artificial Sequence
  derived and/or modified sequence opt5 from hemagglutinin__InfluenzaA__ABC40619
augaagaccaucauugcccugagcuacaucuucugccucgugcugggccaggacuuuuccgggaacgauaauucuacagcuacgcuuugucugggacaccaugccguccccaacggcacccucguuaaaacaauuaccaaugaccaaaucgaggugacaaacgcgaccgaacuggugcagagcuccucuacagggaagauuugcaauaacccucacagaauccuugauggaaucgacuguacccugauugaugcucuccugggcgacccgcauugcgauggguuccagaaugagacgugggaccuguuugucgaacggagcaaagccuucuccaacuguuaucccuacgaugugccugacuaugccucucuccgcagccugguugcuuccagcggaacccuugaguuuaucaaugaaggcuucaacuggacaggcgugacccagaaugggggaucuaacgccugcaagagaggccccgauuccggguuuuucagccggcugaauuggcucuacaaaucuggauccacauauccuguccugaacgugagcaugcccaauaacgacaacuuugauaaacuuuacauuuggggcguucaccauccuucuaccgaccaagagcagacgaaucuguaugugcaggcuuccgggcgcgucacagugagcaccaagagaucccagcaaacaaucauuccgaacaucggaucucggcccugggugcgcggccucagcuccagaauuagcaucuacuggaccaucgucaagccuggcgacauucugguuaucaauucuaacgggaaucugauugcgccccggggauacuucaagaugcgcaccggcaaauccagcaucaugagaucugaugccccuauugggacauguaucagcgagugcaucacgcccaacggauccauuccgaaugacaagccuuuucagaacgugaauaaaaucaccuauggcgccugucccaaguacgugaagcagaacacacucaaacuggcuaccgggaugcggaaugucccugaaaagcagacacgcggaauuuucggcgccaucgcuggcuuuauugagaacgggugggaaggaaugaucgauggcugguauggguucagacaccaaaauucugagggaaccggccaggccgcggaccuuaaaagcacgcaggccgcuaucgaucaaauuaacgggaagcugaaucggaucauugagaaaacaaacgaaaaguuccaccagaucgagaaagaauuuuccgagguggaaggccgcauucaggaccucgagaaguacguugaggauaccaagaucgaccuguggagcuauaacgccgaacuucugguggcucucgagaaucagcauaccauugaucugacagacucugaaaugaacaaacuguucgagaagaccagacggcaacucagagaaaaugccgaggauaugggaaacggcugcuuuaaaaucuaccacaagugugacaaugccugcaucggguccauucgcaacggaacauaugaccaugaugucuaccgggacgaggcucugaauaacagauuccagaucaaaggcguggaacuuaagagcggguacaaggauuggauucuguggaucucuuuugcgauuuccugcuuccuccuguguguugugcuucugggauuuaucaugugggccugccagaaaggcaauauccgcuguaacauuugcaucuga

SEQ ID NO: 183536 - RNA, 1698 nt, Artificial Sequence
  derived and/or modified sequence opt5 from hemagglutinin__InfluenzaA__ABC40631
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucugauucucuggggagugcaucacccuccgaacaucggcgaucagagaacacuguaccacaccgaaaacgccuaugucagcgugguguccucucauuacagccggcgcuucacgcccgagauuacaaaaagaccuaagguccgggaccaggaagggcgcaucaauuauuacuggacccuucuggagcccggagauacaauuaucuuugaggcuaacggcaaucucauugccccuugguaugcguucgcccuguccagaggguuuggaagcggcaucaucaccucuaacgcucccauggacgaaugugaugccaagugccagaccccgcaaggcgcuauuaauuccagccuuccuuuccagaacguucaccccgugacaaucggggaguguccuaaauacgugcggucugccaagcugcgcauggucacgggacucagaaauauucccagcauccagucccggggccuguuuggggcgauugccggauucaucgaaggcggguggaccggaaugguggacggcugguauggcuaccaucaccagaacgagcaagggucuggauacgcugccgaucagaaaagcacacagaaugcuaucaacggcauuaccaauaagguuaacuccgugaucgaaaagaugaauacacaguuuaccgccgucgggaaagaguucaacaaacuggagcgcagaauggaaaaucucaacaagaagguggacgauggauuccuggacauuuggacguauaacgccgagcuucugguucuccuggaaaaugagcggacacuugacuuucacgauagcaacgugaaaaaucuguacgaaaaggucaaaucucaacucaagaacaaugcuaaagagaucggcaacgggugcuucgaguuuuaucauaaguguaauaacgaaugcauggaguccgugaagaauggcaccuacgacuaucccaaauacagcgaagagucuaagcugaaccgcgagaaaauugauggagucaagcuggaauccaugggcguguaucagauccucgcgaucuacagcaccguugccuccucucuggugcuucuggucagccucggggcuauuuccuucuggaugugcucuaauggaagccugcaguguagaaucugcauuuga

SEQ ID NO: 183537 - RNA, 1701 nt, Artificial Sequence
  derived and/or modified sequence opt5 from hemagglutinin__InfluenzaA__ABC41692
augaagaccaucauugcccugagcuacauccucugccugguguucgcucagaaacccccuggcaacgacaauuccacagccacgcuuugucuggggcaccaugcggucccgaacggaaccauuguuaagacaaucaccaaugaucaaauugaggugacaaacgcuaccgaacucgugcagucuagcuccacaggcgggaucugcgacucuccccaccagauccuggauggagagaauuguacccuuauugacgcccugcucggcgauccucagugcgacggguuucaaaacaaaaagugggaucuguucgucgaaagaagcaaagccuauuccaauuguuaccccuaugacgugccugaucaugcuucucugcggagccucguugccuccagcggaacgcuggaguuuaacaaugaaucuuucgacuggaccggcgugacacagaacggcaccuccagcgcuugcaagcgcagaucuaauaaguccuuuuucagccggcuuaacuggcugacacaccucaaauacaaguaucccgcccugaaugucaccaugccuaacaaugagaaauuugauaaacuuuacaucuggggagugcaucacccggggacggacucugaucagauuucccuguaugcgcaggccagcggccgcaucacaguuuccaccaagagaucucaacagacagugauucccaacaucgggagccggccucgcgucagagacguguccagccggauuucuaucuacuggaccaucgugaagcccggagacauucuccugaucaacuccaccggcaaucugauugcuccucgcggguacuucaagaucagaagcggaaaaucuagcauuaugcgguccgaugcccccaucggcaaguguaacucugagugcaucacaccgaauggcagcauuccuaacgacaaacccuuucagaaugucaaccgcaucacguauggggcuuguccuagauacguuaagcagaauacccucaaacuggccacaggaaugcggaacgugcccgaaaagcaaacccgcggcauuuucggggcgaucgccggauuuauugagaauggcugggaagggaugguggauggaugguauggcuucagacaccagaacuccgagggcacagggcaggcugccgaccuuaaaagcacccaagcugccaucaaucagaucaacggaaagcugaaucggcucauuggcaagacgaacgagaaauuucaucagaucgaaaaggaguucucugaagucgaggggcgcauucaggaucuggaaaaauacguggaggacacaaagaucgaucuuugguccuauaaugccgagcugcucguugcucuggaaaaccaacacaccauugaccugaccgauagcgagaugaacaaacucuucgaaagaacaaagaagcagcugcgggagaaugcggaagacaugggaaacggcugcuuuaaaaucuaccauaagugugauaaugccugcauugggucuaucagaaacggcaccuaugaccacgacguguaccgcgaugaggcucuuaauaaccgguuccagaucaaaggagucgagcugaaguccggcuacaaagacuggauucucuggaucagcuuugccauuuccugcuuccugcuuuguguggcccugcucggguuuaucaugugggcuugccagaagggaaauauuagauguaacaucugcaucuga

SEQ ID NO: 183538 - RNA, 1698 nt, Artificial Sequence; identical to SEQ ID NO: 183323
  derived and/or modified sequence opt5 from hemagglutinin__InfluenzaA__ABC41714

SEQ ID NO: 183539 - RNA, 1701 nt, Artificial Sequence
  derived and/or modified sequence opt5 from hemagglutinin__InfluenzaA__ABC41725
augaagaccacaaucgcccugagcuacauucucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacccuugaguuuaacaaugaaucuuucgacuggacaggcgugacccagaacggcacauccagcgcuugcaagcgcagaucuaauaaguccuuuuucagccggcugaacuggcucacccaccugaaauacaaguauccugcccuuaaugucacgaugcccaacaaugagaaauuugauaagcuguacauuuggggagugcaucacccugggacagacucugaucagaucucccucuaugcgcaggccagcggccgcauuaccguuuccacaaaaagaucucaacagaccgugaucccgaacauugggagccggccccgcgucagagacguguccagccggaucucuauuuacuggaccaucgugaagccuggagacauccugcugauuaacuccacaggcaaucucaucgcuccccgcggguacuucaagauuagaagcggaaaaucuagcaucaugcgguccgaugccccuauuggcaaguguaacucugagugcaucacgcccaauggcagcaucccgaacgacaaaccuuuucagaaugucaaccgcauuaccuauggggcuugucccagauacguuaagcagaauacacugaaacuugccaccggaaugcggaacgugccugaaaagcaaacacgcggcaucuucggggcgauugccggauuuaucgagaauggcugggaagggaugguggauggaugguauggcuucagacaccagaacuccgagggcaccgggcaggcugccgaccugaaaagcacgcaagcugccauuaaucagaucaacggaaagcucaaucggcugaucggcaagacaaacgagaaauuucaucagauugaaaaggaguucucugaagucgaggggagaauccaggaucuugaaaaauacguggaggacaccaagauugaucugugguccuauaaugccgagcuccugguugcucuggaaaaccaacacaccaucgaccucacagauagcgagaugaacaaacuguucgaacgcaccaagaagcagcuucgggagaaugcggaagacaugggaaacggcugcuuuaaaauuuaccauaagugugauaaugccugcaucgggucuauuagaaacggcacauaugaccacgacguguaccgcgaugaggcucugaauaaccgguuccagaucaaaggagucgagcucaaguccggcuacaaagacuggauccuguggauuagcuuugccaucuccugcuuccuucuguguguggcccuccugggguuuauuaugugggcuugccagaagggaaauaucagauguaacauuugcaucuga

SEQ ID NO: 183540 - RNA, 1701 nt, Artificial Sequence
  derived and/or modified sequence opt5 from hemagglutinin__InfluenzaA__ABC41736
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcugccaucaaucagaucaacggaaagcucaaucggcugauuggcaagacgaacgagaaauuucaucagaucgaaaaggaguucucugaagucgaggggcgcauucaggaucuugaaaaauacguggaggacacaaagaucgaucugugguccuauaaugccgagcuccugguugcucuggaaaaccaacacaccauugaccucaccgauagcgagaugaacaaacuguucgaaagaacaaagaagcagcuucgggagaaugcggaagacaugggaaacggcugcuuuaaaaucuaccauaagugugauaaugccugcauugggucuaucagaaacggcaccuaugaccacgacguguaccgcgaugaggcucugaauaaccgguuccagaucaaaggagucgagcucaaguccggcuacaaagacuggauucuguggaucagcuuugccauuuccugcuuccuucuguguguggcccuccugggguuuaucaugugggcuugccagaagggaaauauuagauguaacaucugcaucuga

SEQ ID NO: 183541 - RNA, 1701 nt, Artificial Sequence; identical to SEQ ID NO: 183540
  derived and/or modified sequence opt5 from hemagglutinin__InfluenzaA__ABC41952

SEQ ID NO: 183542 - RNA, 1701 nt, Artificial Sequence; identical to SEQ ID NO: 183540
  derived and/or modified sequence opt5 from hemagglutinin__InfluenzaA__ABC41953

SEQ ID NO: 183543 - RNA, 1701 nt, Artificial Sequence; identical to SEQ ID NO: 183540
  derived and/or modified sequence opt5 from hemagglutinin__InfluenzaA__ABC41964

SEQ ID NO: 183544 - RNA, 1701 nt, Artificial Sequence; identical to SEQ ID NO: 183540
  derived and/or modified sequence opt5 from hemagglutinin__InfluenzaA__ABC42014

SEQ ID NO: 183545 - RNA, 1701 nt, Artificial Sequence; identical to SEQ ID NO: 183540
  derived and/or modified sequence opt5 from hemagglutinin__InfluenzaA__ABC42114

SEQ ID NO: 183546 - RNA, 1701 nt, Artificial Sequence; identical to SEQ ID NO: 183540
  derived and/or modified sequence opt5 from hemagglutinin__InfluenzaA__ABC42125

SEQ ID NO: 183547 - RNA, 1701 nt, Artificial Sequence; identical to SEQ ID NO: 183540
  derived and/or modified sequence opt5 from hemagglutinin__InfluenzaA__ABC42136

SEQ ID NO: 183548 - RNA, 1701 nt, Artificial Sequence
  derived and/or modified sequence opt5 from hemagglutinin__InfluenzaA__ABC42147
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugucccuaucggcaaguguaacucugagugcaucacacccaauggcagcauuccgaacgacaaaccuuuucagaauguuaaccgcaucacguauggggccugucccagauacgugaagcagaauacccugaaacuugcuacaggaaugcggaacgugccugaaaagcaaacccgcggcauuuucggggccaucgcgggauuuauugagaauggcugggaagggauggucgauggaugguauggcuucagacaccagaacuccgagggcacagggcaggccgcugaccugaaaagcacccaagccgcuaucaaucagaucaacggaaagcucaaucggcugauuggcaagacgaacgagaaauuucaucagaucgaaaaggaguucucugaaguggaggggcgcauucaggaucuugaaaaauacguugaggacacaaagaucgaucugugguccuauaaugccgagcuccugguggcccuggaaaaccaacacaccauugaccucaccgauagcgagaugaacaaacuguucgaaagaacaaagaagcagcuucgggagaaugcugaagacaugggaaacggcugcuuuaaaaucuaccauaagugugauaaugcgugcauugggucuaucagaaacggcaccuaugaccacgacgucuaccgcgaugaggcccugaauaaccgguuccagaucaaaggaguggagcucaaguccggcuacaaagacuggauucuguggaucagcuuugcuauuuccugcuuccuucuguguguugcccuccugggguuuaucaugugggccugccagaagggaaauauuagauguaacaucugcaucuga

SEQ ID NO: 183549 - RNA, 1701 nt, Artificial Sequence; identical to SEQ ID NO: 183540
  derived and/or modified sequence opt5 from hemagglutinin__InfluenzaA__ABC42158

SEQ ID NO: 183550 - RNA, 1701 nt, Artificial Sequence; identical to SEQ ID NO: 183540
  derived and/or modified sequence opt5 from hemagglutinin__InfluenzaA__ABC42169

SEQ ID NO: 183551 - RNA, 1701 nt, Artificial Sequence; identical to SEQ ID NO: 183540
  derived and/or modified sequence opt5 from hemagglutinin__InfluenzaA__ABC42180

SEQ ID NO: 183552 - RNA, 1701 nt, Artificial Sequence; identical to SEQ ID NO: 183540
  derived and/or modified sequence opt5 from hemagglutinin__InfluenzaA__ABC42192

SEQ ID NO: 183553 - RNA, 1701 nt, Artificial Sequence; identical to SEQ ID NO: 183540
  derived and/or modified sequence opt5 from hemagglutinin__InfluenzaA__ABC42307

SEQ ID NO: 183554 - RNA, 1701 nt, Artificial Sequence
  derived and/or modified sequence opt5 from hemagglutinin__InfluenzaA__ABC42318
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcugccaucaaucagaucaacggaaagcucaaucggcugauuggcaagacgaacgagaaauuucaucagaucgaaaaggaguucucugaagucgaggggcgcauucaggaucuugaaaaauacguggaggacacaaagaucgaucugugguccuauaaugccgaguuccucguugcucuggaaaaccaacacaccauugaccugaccgauagcgagaugaacaaacucuuugaaagaacaaagaagcagcugcgggagaaugcggaagacaugggaaacggcugcuucaaaaucuaccauaagugugauaaugccugcauugggucuaucagaaacggcaccuaugaccacgacguguaccgcgaugaggcucuuaauaaccgguuucagaucaaaggagucgagcugaaguccggcuacaaagacuggauucucuggaucagcuucgccauuuccugcuuucugcuuuguguggcccugcucggguucaucaugugggcuugccagaagggaaauauuagauguaacaucugcaucuga

SEQ ID NO: 183555 - RNA, 1701 nt, Artificial Sequence; identical to SEQ ID NO: 183540
  derived and/or modified sequence opt5 from hemagglutinin__InfluenzaA__ABC42346

SEQ ID NO: 183556 - RNA, 1701 nt, Artificial Sequence; identical to SEQ ID NO: 183540
  derived and/or modified sequence opt5 from hemagglutinin__InfluenzaA__ABC42461

SEQ ID NO: 183557 - RNA, 1701 nt, Artificial Sequence; identical to SEQ ID NO: 183540
  derived and/or modified sequence opt5 from hemagglutinin__InfluenzaA__ABC42494

SEQ ID NO: 183558 - RNA, 1701 nt, Artificial Sequence; identical to SEQ ID NO: 183540
  derived and/or modified sequence opt5 from hemagglutinin__InfluenzaA__ABC42505

SEQ ID NO: 183559 - RNA, 1701 nt, Artificial Sequence
  derived and/or modified sequence opt5 from hemagglutinin__InfluenzaA__ABC42516
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcugccaucaaucagaucaacggaaagcucaauaagcugauuggcaaaacgaacgagaaguuucaucagaucgaaaaagaguucucugaagucgaggggcggauucaggaucuugaaaaguacguggaggacacaaaaaucgaucugugguccuauaaugccgagcuccugguugcucuggaaaaccaacacaccauugaccucaccgauagcgagaugaacaagcuguucgaaagaacaaagaaacagcuucgcgagaaugcggaagacaugggaaacggcugcuuuaagaucuaccauaaaugugauaaugccugcauugggucuauccggaacggcaccuaugaccacgacguguacagagaugaggcucugaauaaccgcuuccagaucaagggagucgagcucaaauccggcuacaaggacuggauucuguggaucagcuuugccauuuccugcuuccuucuguguguggcccuccugggguuuaucaugugggcuugccagaagggaaauauucgguguaacaucugcaucuga

SEQ ID NO: 183560 - RNA, 1701 nt, Artificial Sequence; identical to SEQ ID NO: 183540
  derived and/or modified sequence opt5 from hemagglutinin__InfluenzaA__ABC42527

SEQ ID NO: 183561 - RNA, 1701 nt, Artificial Sequence; identical to SEQ ID NO: 183540
  derived and/or modified sequence opt5 from hemagglutinin__InfluenzaA__ABC42574

SEQ ID NO: 183562 - RNA, 1701 nt, Artificial Sequence; identical to SEQ ID NO: 183540
  derived and/or modified sequence opt5 from hemagglutinin__InfluenzaA__ABC42585

SEQ ID NO: 183563 - RNA, 1701 nt, Artificial Sequence; identical to SEQ ID NO: 183267
  derived and/or modified sequence opt5 from hemagglutinin__InfluenzaA__ABC42596

SEQ ID NO: 183564 - RNA, 1701 nt, Artificial Sequence; identical to SEQ ID NO: 183306
  derived and/or modified sequence opt5 from hemagglutinin__InfluenzaA__ABC42607

SEQ ID NO: 183565 - RNA, 1701 nt, Artificial Sequence; identical to SEQ ID NO: 183306
  derived and/or modified sequence opt5 from hemagglutinin__InfluenzaA__ABC42618

SEQ ID NO: 183566 - RNA, 1701 nt, Artificial Sequence
  derived and/or modified sequence opt5 from hemagglutinin__InfluenzaA__ABC42629
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaccugaaguuuaaauacccugcccuuaaugucaccaugcccaacaacgagaaguucgacaaacuguauaucuggggagugcaucacccugggacggauaaugaccagauuucucucuacgcgcaggccuccggccgcaucacaguuagcaccaagagaucccaacagacagugauuccgaacaucgggucucggccccgcgucagagauauuccuagccggaucuccaucuauuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguacggggcuuguccuagauaugucaaacagaacacccugaaacuugccacaggaaugcggaauguucccgaaaaacaaacccgcggcaucuuuggggcgauugccggauucaucgagaacggcugggaagggaugguggacggaugguacggcuuuagacaccagaauagcgagggcacagggcaggcugccgaucugaagucuacccaagcugccaucaaccagauuaauggaaaacucaaccggcugaucggcaagacgaacgagaaguuccaucagauugaaaaagaguucuccgaaguggaggggagaauccaggaccuugaaaaguaugucgaggauacaaaaauugaccuguggagcuacaaugccgagcuccugguggcucuggaaaaccaacacaccaucgaucucaccgacucugagaugaauaagcuguuugaacgcacaaagaagcagcuucgggagaacgcggaagauaugggaaauggcugcuucaagauuuaucauaaaugugacaacgccugcaucggguccaucagaaauggcaccuacgaucacgacguuuaucgcgacgaggcucugaacaaucgguuucagauuaagggaguggagcucaaaagcggcuacaaggauuggauccuguggauuucuuucgccaucuccugcuuucuucugugugucgcccuccugggguucauuaugugggcuugccagaaaggaaacaucagauguaauaucugcauuuga

SEQ ID NO: 183567 - RNA, 1701 nt, Artificial Sequence
  derived and/or modified sequence opt5 from hemagglutinin__InfluenzaA__ABC42640
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucaacuggaccggcgugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggagugcaccauccugggacggauaaugaccagaucucucuguaugcgcaggccuccggccgcauuacaguuagcaccaagagaucccaacagacagugaucccgaacauugggucucggccccgcgucagagauaucccuagccggaucuccauuuacuggaccaucgugaaacccggagacauucuccugaucaauagcaccggcaaccugauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgucaaacagaacacccucaagcuggccacaggaaugcggaauguucccgaaaaacaaacccgcggcauuuuuggggcgaucgccggauucaucgagaacggcugggaagggaugguggacggaugguauggcuuuagacaccaaaauucugagggcauugggcaggcugccgaucuuaagagcacacaggcugccaucaaccagauuaauggaaaacugaaccggcucaucggcaagaccaacgagaaguuccaccagauugaaaaagaguucuccgaaguggaggggagaauccaggaccuggaaaaguacgucgaggauacgaaaauugaccuuuggagcuauaaugccgagcugcucguggcucuggaaaaccaacauacaaucgaucugaccgacucugagaugaauaagcucuuugaacgcaccaaaaagcagcugcgggagaacgcggaagauaugggaaauggcugcuucaagaucuaccacaaaugugacaacgccugcauuggguccaucagaaauggcacauaugaucaugacguuuaccgcgacgaggcucuuaacaaucgguuucagauuaagggaguggagcugaaaagcggcuacaaggauuggauccucuggauuucuuucgccaucuccugcuuucugcuuugugucgcccugcucggguucaucaugugggcuugccagaaaggaaacauuagauguaauaucugcauuuga

SEQ ID NO: 183568 - RNA, 1701 nt, Artificial Sequence; identical to SEQ ID NO: 183267
  derived and/or modified sequence opt5 from hemagglutinin__InfluenzaA__ABC42651

SEQ ID NO: 183569 - RNA, 1701 nt, Artificial Sequence
  derived and/or modified sequence opt5 from hemagglutinin__InfluenzaA__ABC42662
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgaguuucucguggcucuggaaaaccaacauacaauugaucugaccgacucugagaugaauaaacucuucgaaagaaccaagaagcagcugcgggagaacgcggaagauaugggaaauggcugcuuuaagaucuaccacaaaugugacaacgccugcaucggguccauuagaaauggcacauaugaucaugacguuuaccgcgacgaggcucuuaacaaucgguuccagaucaagggaguggagcugaaaagcggcuacaaggauuggauucucuggaucucuuuugccauuuccugcuuccugcuuugugucgcccugcucggguuuaucaugugggcuugccagaaaggaaacaucagauguaauauuugcaucuga

SEQ ID NO: 183570 - RNA, 1701 nt, Artificial Sequence
  derived and/or modified sequence opt5 from hemagglutinin__InfluenzaA__ABC42673
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgggaucugcgacucuccgcaccagauucuugauggagagaauuguacccugaucgacgcccuccugggcgauccccagugcgacggguuucaaaacaaaaagugggaucuguucguggaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucccuagccggaucuccauuuacuggaccaucgucaaacccggagacauucugcugaucaauagcaccggcaaccucauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgugaaacagaacacccugaagcuggccacaggaaugcggaauguccccgaaaaacaaacccgcggcauuuuuggggcgaucgccggauucaucgagaacggcugggaagggaugguugacggaugguauggcuuuagacaccaaaauucugagggcauugggcaggcugccgaucuuaagagcacacaggcugccaucaaccagauuaauggaaaacucaaccggcugaucggcaagaccaacgagaaguuccaccagauugaaaaagaguucuccgaaguggaggggagaauccaggaccuugaaaaguacguggaggauacgaaaauugaccuguggagcuauaaugccgagcuccuggucgcucuggaaaaccaacauacaaucgaucucaccgacucugagaugaauaagcuguuugaacgcaccaaaaagcagcuucgggagaacgcggaagauaugggaaauggcugcuucaagaucuaccacaaaugugacaacgccugcauuggguccaucagaaauggcacauaugaucaugacguguaccgcgacgaggcucugaacaaucgguuucagauuaagggaguugagcucaaaagcggcuacaaggauuggauccuguggauuucuuucgccaucuccugcuuucuucuguguguggcccuccugggguucaucaugugggcuugccagaaaggaaacauuagauguaauaucugcauuuga

SEQ ID NO: 183571 - RNA, 1701 nt, Artificial Sequence; identical to SEQ ID NO: 183267
  derived and/or modified sequence opt5 from hemagglutinin__InfluenzaA__ABC42684

SEQ ID NO: 183572 - RNA, 1701 nt, Artificial Sequence; identical to SEQ ID NO: 183267
  derived and/or modified sequence opt5 from hemagglutinin__InfluenzaA__ABC42695

SEQ ID NO: 183573 - RNA, 1701 nt, Artificial Sequence
  derived and/or modified sequence opt5 from hemagglutinin__InfluenzaA__ABC42706
augaagaccaucauugcccugagcuacauccucugccugguguucgcucagaaacuucccggcaacgacaauuccacagccacgcugugucucgggcaccaugcggucccuaacggaaccacaguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucaacuggacaggcgugacccagaauggcacauccagcgcuugcaagcgcagaucuaacaauuccuuuuucagccggcugaacuggcucacccaucugaaguuuaaauauccugcccuuaaugucacgaugcccaacaacgagaaguucgacaaacuguacauuuggggagugcaccauccugggacagauaaugaccagaucucucucuaugcgcaggccuccggccgcauuaccguuagcacaaagagaucccaacagaccgugaucccgaacauugggucucggccccgcgucagagauaucccuagccggauuuccaucuacuggaccaucgugaaacccggagacauucugcugaucaauagcacaggcaaccucauugcuccucgcggguacuuuaagaucagaucuggaaaguccagcauuaugcggucugacgcccccaucggcaaauguaauagcgagugcaucacgccgaacggcuccauuccuaaugauaagcccuuccagaacgugaaucgcaucaccuauggggcuuguccuagauacgucaaacagaacacacugaaacuugccaccggaaugcggaauguucccgaaaaacaaacacgcggcauuuuuggggcgaucgccggauucauugagaacggcugggaagggaugguggacggaugguauggcuuuagacaccagaauagcgagggcaucgggcaggcugccgaucugaagucuacccaagcugccaucaaccagauuaauggaaaacucaaccggcugaucggcaagacgaacgagaaguuccaccagauugaaaaagaguucuccgaaguggaggggagaauccaggaccuugaaaaguacgucgaggauacaaaaauugaccuguggagcuauaaugccgagcuccugguggcucuggaaaaccaacauaccaucgaucucaccgacucugagaugaauaagcuguuugaacgcacaaagaagcagcuucgggagaacgcggaagauaugggaaauggcugcuucaagauuuaccacaaaugugacaacgccugcaucggguccaucagaaauggcaccuaugaucaugacguuuaccgcgacgaggcucugaacaaucgguuucagauuaagggaguggagcucaaaagcggcuacaaggauuggauccuguggauuucuuucgccaucuccugcuuucuucugugugucgugcuccugggguucauuaugugggccugccagaaaggaaacaucagauguaauaucugcauuuga

SEQ ID NO: 183574 - RNA, 1701 nt, Artificial Sequence; identical to SEQ ID NO: 183267
  derived and/or modified sequence opt5 from hemagglutinin__InfluenzaA__ABC42717

SEQ ID NO: 183575 - RNA, 1701 nt, Artificial Sequence
  derived and/or modified sequence opt5 from hemagglutinin__InfluenzaA__ABC42728
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgggauuugcgacucuccgcaccagauccuugauggagagaauuguacccugauggacgcccuccugggcgauccccagugcgacggguuucaaaacaaaaagugggaucuguucguggaaagaagccgggccuauuccaauuguuacccuuaugacguucccgauuacgcuucucuccgcagccugguggccuccagcggaacgcuugaguuuaacaaugaaucuuucaacuggaccggcgucacacagaauggcaccuccagcgcuugcaaaagacggucuaacaauuccuuuuucagccgccugaacuggcucacacaucugaaguuuaaguauccugcccuuaaugugaccaugcccaacaacgagaaauucgacaagcuguacaucuggggaguucaccauccugggacggauaaugaccagauuucucucuaugcgcaggccuccggcagaaucacagugagcaccaaacggucccaacagacagucauuccgaacaucgggucucgccccagagugcgggauauuccuagccgcaucuccauuuacuggaccaucgugaagcccggagacauccugcugauuaauagcaccggcaaccucaucgcuccuagaggguacuuuaaaauucggucuggaaaguccagcaucaugcgcucugacgcccccauuggcaaguguaauagcgagugcaucacaccgaacggcuccaucccuaaugauaaacccuuccagaacgucaauagaauuacguauggggcuuguccucgguacguuaagcagaacacccugaaacuugccacaggaaugcgcaaugugcccgaaaagcaaaccagaggcaucuuuggggcgauugccggauucaucgagaacggcugggaagggaugguggacggaugguauggcuuucggcaccaaaauucugagggcacagggcaggcugccgaucugaaaagcacccaggcugccauuaaccagaucaauggaaagcucaacagacugaucggcaaaacgaacgagaaguuccaccagauugaaaaggaguucuccgaagucgaggggcgcauccaggaccuugaaaaauacguggaggauacaaagauugaccuguggagcuauaaugccgagcuccugguugcucuggaaaaccaacauaccaucgaucucaccgacucugagaugaauaaacuguuugaacggacaaagaaacagcuuagagagaacgcggaagauaugggaaauggcugcuucaagauuuaccacaagugugacaacgccugcaucggguccauucgcaauggcaccuaugaucaugacguguaccgggacgaggcucugaacaauagauuucagaucaaaggagucgagcucaagagcggcuacaaagauuggauccuguggauuucuuucgccaucuccugcuuucuucugugugugguucuccugggguucauuaugugggccugccagaagggaaacauccgcuguaauauuugcaucuga

SEQ ID NO: 183576 - RNA, 1701 nt, Artificial Sequence; identical to SEQ ID NO: 183267
  derived and/or modified sequence opt5 from hemagglutinin__InfluenzaA__ABC42739

SEQ ID NO: 183577 - RNA, 1698 nt, Artificial Sequence
  derived and/or modified sequence opt5 from hemagglutinin__InfluenzaA__ABC42750
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagaaggcccuguaccauaccgaaaacgcuuacgugagcgucguuuccucucacuauagccgcaaauucacacccgagauugccaagagaccuaaagugcgggaccaggaagggcgcaucaauuacuauuggacccuucuggagcccggagauacgauuaucuuugaggcgaacggcaaucucauugccccuagauacgcuuucgcccugucccggggguuuggaagcggcaucauuaacucuaaugcucccauggacgaaugugaugccaagugccagacaccgcaaggcgcgaucaacuccagccuuccuuuccagaaugugcaucccgucaccaucggggaguguccuaaauaugugcgcucugccaagcugagaaugguuacaggacuccggaacauucccagcauccagucccgcggccuguuuggggcuauugccggauucaucgaaggcggguggaccggaaugguggacggcugguacggcuaucaccaccagaaugagcaagggucuggauacgcugccgaucagaaaagcacccagaacgccauuaauggcaucacaaacaaggucaauuccgugaucgaaaagaugaacacgcaguuuaccgcuguugggaaagaguucaauaagcuggagagacggauggaaaaccucaacaaaaagguggacgauggauucauugacaucuggacauacaaugcggagcugcuuguccugcucgaaaacgagcgcacccuggacuuucaugauagcaaugugaaaaaccuuuaugaaaaggucaagucucaacugaaaaauaacgccaaggagauuggcaaugggugcuucgaguuuuaccacaaauguaacgacgaaugcauggaguccgugaagaauggcacauaugauuaccccaaauauagcgaagagucuaagcucaacagagagaagaucgacggaguuaaacuggaauccaugggcguguaccagauucuggcuaucuauagcaccgucgccuccucucucgugcugcuuguuagccugggggccaucuccuucuggaugugcucuaauggaagccuccagugucggauuugcaucuga

SEQ ID NO: 183578 - RNA, 1701 nt, Artificial Sequence; identical to SEQ ID NO: 183267
  derived and/or modified sequence opt5 from hemagglutinin__InfluenzaA__ABC42761

SEQ ID NO: 183579 - RNA, 1701 nt, Artificial Sequence
  derived and/or modified sequence opt5 from hemagglutinin__InfluenzaA__ABC42772
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcucuggaaaaccaacauacaauugaucucaccgacucugagaugaauaagcuguuugaaagaaccaaaaagcagcuucgggagaacgcggaagauaugggaaauggcugcuucaagaucuaccacaaaugugacaacgccugcaucggguccauuagaaauggcacauaugaucaugacguuuaccgcgacgaggcucugaacaaucgguuucagaucaagagcguggagcucaaaucuggauacaaggauuggauucuguggaucuccuucgccauuagcugcuuucuucugugugucgcccuccugggcuucaucaugugggcuugccagaaagggaacaucagauguaauauuugcaucuga

SEQ ID NO: 183580 - RNA, 1701 nt, Artificial Sequence; identical to SEQ ID NO: 183267
  derived and/or modified sequence opt5 from hemagglutinin__InfluenzaA__ABC42783

SEQ ID NO: 183581 - RNA, 1701 nt, Artificial Sequence; identical to SEQ ID NO: 183267
  derived and/or modified sequence opt5 from hemagglutinin__InfluenzaA__ABC42794

SEQ ID NO: 183582 - RNA, 1701 nt, Artificial Sequence; identical to SEQ ID NO: 183267
  derived and/or modified sequence opt5 from hemagglutinin__InfluenzaA__ABC42805

SEQ ID NO: 183583 - RNA, 1701 nt, Artificial Sequence; identical to SEQ ID NO: 183306
  derived and/or modified sequence opt5 from hemagglutinin__InfluenzaA__ABC42816

SEQ ID NO: 183584 - RNA, 1701 nt, Artificial Sequence
  derived and/or modified sequence opt5 from hemagglutinin__InfluenzaA__ABC42827
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggauguccaucuacuggaccaucgugaaacccggagacauucugcugaucaauagcaccggcaaccucauugcuccucgcggguacuuuaagaucagaucuggaaaguccagcauuaugcggucugacgcccccaucggcaaauguaauagcgagugcaucacaccgaacggcuccauuccuaaugauaagcccuuccagaacgugaaucgcaucacguauggggcuuguccuagauacgucaaacagaacacccugaagcuggccacaggaaugcggaauguucccgaaaaacaaacccgcggcauuuuuggggcgaucgccggauucauugagaacggcugggaagggaugguggacggaugguauggcuuuagacaccaaaauucugagggcaucgggcaggcugccgaucuuaagagcacacaggcugccaucaaccagauuaauggaaaacucaaccggcugaucggcaagaccaacgagaaguuccaccagauugaaaaagaguucuccgaaguggaggggagaauccaggaccuugaaaaguacgucgaggauacgaaaauugaccuguggagcuauaaugccgagcuccugguggcucuggaaaaccaacauacaaucgaucucaccgacucugagaugaauaagcuguuugaacgcaccaaaaagcagcuucgggagaacgcggaagauaugggaaauggcugcuucaagauuuaccacaaaugugacaacgccugcaucggguccaucagaaauggcacauaugaucaugacguuuaccgcgacgaggcucugaacaaucgguuucagauuaagggaguggagcucaaaagcggcuacaaggauuggauccuguggauuucuuucgccaucuccugcuuucuucugugugucgcccuccugggguucauuaugugggcuugccagaaaggaaacaucagauguaauaucugcauuuga

SEQ ID NO: 183585 - RNA, 1701 nt, Artificial Sequence; identical to SEQ ID NO: 183267
  derived and/or modified sequence opt5 from hemagglutinin__InfluenzaA__ABC42849

SEQ ID NO: 183586 - RNA, 1701 nt, Artificial Sequence
  derived and/or modified sequence opt5 from hemagglutinin__InfluenzaA__ABC42882
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccagauuaagggcguggagcugaaauccggauauaaggauuggguucuuuggaucagcuuugccaucuccugcuuccugcucuguauugugcugcugggcuuuaucaugugggccugccagaaagggaauauuagauguaacaucugcauuuga

SEQ ID NO: 183587 - RNA, 1701 nt, Artificial Sequence; identical to SEQ ID NO: 183586
  derived and/or modified sequence opt5 from hemagglutinin__InfluenzaA__ABC42893

SEQ ID NO: 183588 - RNA, 1701 nt, Artificial Sequence; identical to SEQ ID NO: 183540
  derived and/or modified sequence opt5 from hemagglutinin__InfluenzaA__ABC42929

SEQ ID NO: 183589 - RNA, 1701 nt, Artificial Sequence; identical to SEQ ID NO: 183540
  derived and/or modified sequence opt5 from hemagglutinin__InfluenzaA__ABC42940

SEQ ID NO: 183590 - RNA, 1701 nt, Artificial Sequence; identical to SEQ ID NO: 183540
  derived and/or modified sequence opt5 from hemagglutinin__InfluenzaA__ABC42951

SEQ ID NO: 183591 - RNA, 1701 nt, Artificial Sequence; identical to SEQ ID NO: 183540
  derived and/or modified sequence opt5 from hemagglutinin__InfluenzaA__ABC42962

SEQ ID NO: 183592 - RNA, 1701 nt, Artificial Sequence; identical to SEQ ID NO: 183540
  derived and/or modified sequence opt5 from hemagglutinin__InfluenzaA__ABC42973

SEQ ID NO: 183593 - RNA, 1701 nt, Artificial Sequence; identical to SEQ ID NO: 183540
  derived and/or modified sequence opt5 from hemagglutinin__InfluenzaA__ABC42995

SEQ ID NO: 183594 - RNA, 1701 nt, Artificial Sequence; identical to SEQ ID NO: 183540
  derived and/or modified sequence opt5 from hemagglutinin__InfluenzaA__ABC43006

SEQ ID NO: 183595 - RNA, 1701 nt, Artificial Sequence; identical to SEQ ID NO: 183540
  derived and/or modified sequence opt5 from hemagglutinin__InfluenzaA__ABC43028

SEQ ID NO: 183596 - RNA, 1701 nt, Artificial Sequence; identical to SEQ ID NO: 183540
  derived and/or modified sequence opt5 from hemagglutinin__InfluenzaA__ABC43039

SEQ ID NO: 183597 - RNA, 1701 nt, Artificial Sequence; identical to SEQ ID NO: 183540
  derived and/or modified sequence opt5 from hemagglutinin__InfluenzaA__ABC43050

SEQ ID NO: 183598 - RNA, 1701 nt, Artificial Sequence; identical to SEQ ID NO: 183540
  derived and/or modified sequence opt5 from hemagglutinin__InfluenzaA__ABC43061

SEQ ID NO: 183599 - RNA, 1701 nt, Artificial Sequence
  derived and/or modified sequence opt5 from hemagglutinin__InfluenzaA__ABC43072
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcugccaucaaucagaucaacggaaagcucaaucggcugauuggcaagacgaacgagaaauuucaucagaucgaaaaggaguucucugaagucgaggggcgcauucaggaucuugaaaaauacguggaggacacaaagaucgaucugugguccuauaaugccgagcuccugguugcucuggaaaaccaacacaccauugaccucaccgauagcgagaugaacaaacuguucgaaaagacaaagaaacagcuuagagagaaugcggaagacaugggaaacggcugcuuuaagaucuaccauaaaugugauaaugccugcauugggucuauccggaacggcaccuaugaccacgacguguacagagaugaggcucugaauaaccgcuuccagaucaagggagucgagcucaaauccggcuacaaggacuggauucuguggaucagcuuuacaauuuccugcuuccuucuguguguggcccuccugggguuuaucaugugggccugccagaagggaaauauucgguguaacaucugcaucuga

SEQ ID NO: 183600 - RNA, 1701 nt, Artificial Sequence; identical to SEQ ID NO: 183540
  derived and/or modified sequence opt5 from hemagglutinin__InfluenzaA__ABC43083

SEQ ID NO: 183601 - RNA, 1701 nt, Artificial Sequence; identical to SEQ ID NO: 183540
  derived and/or modified sequence opt5 from hemagglutinin__InfluenzaA__ABC43094

SEQ ID NO: 183602 - RNA, 1701 nt, Artificial Sequence; identical to SEQ ID NO: 183540
  derived and/or modified sequence opt5 from hemagglutinin__InfluenzaA__ABC43116

SEQ ID NO: 183603 - RNA, 1701 nt, Artificial Sequence; identical to SEQ ID NO: 183267
  derived and/or modified sequence opt5 from hemagglutinin__InfluenzaA__ABC43127

SEQ ID NO: 183604 - RNA, 1701 nt, Artificial Sequence; identical to SEQ ID NO: 183306
  derived and/or modified sequence opt5 from hemagglutinin__InfluenzaA__ABC43138

SEQ ID NO: 183605 - RNA, 1701 nt, Artificial Sequence; identical to SEQ ID NO: 183267
  derived and/or modified sequence opt5 from hemagglutinin__InfluenzaA__ABC43149

SEQ ID NO: 183606 - RNA, 1701 nt, Artificial Sequence; identical to SEQ ID NO: 183267
  derived and/or modified sequence opt5 from hemagglutinin__InfluenzaA__ABC43160

SEQ ID NO: 183607 - RNA, 1701 nt, Artificial Sequence; identical to SEQ ID NO: 183267
  derived and/or modified sequence opt5 from hemagglutinin__InfluenzaA__ABC43171

SEQ ID NO: 183608 - RNA, 1701 nt, Artificial Sequence; identical to SEQ ID NO: 183267
  derived and/or modified sequence opt5 from hemagglutinin__InfluenzaA__ABC43182

SEQ ID NO: 183609 - RNA, 1701 nt, Artificial Sequence
  derived and/or modified sequence opt5 from hemagglutinin__InfluenzaA__ABC43475
augaagaccaucauugcccugagcuacauccucugccugguguucgcucagaaacuucccggcaacgacaauuccacagccacgcugugucucgggcaccaugcggucccuaacggaaccacaguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucaacuggacaggcgugacccagaauggcacauccagcgcuugcaagcgcagaucuaacaauuccuuuuucagccggcugaacuggcucacccaucugaaguuuaaauauccugcccuuaaugucacgaugcccaacaacgagaaguucgacaaacuguacauuuggggagugcaccauccugggacagauaaugaccagaucucucucuaugcgcaggccuccggccgcauuaccguuagcacaaagagaucccaacagaccgugaucccgaacauugggucucggccccgcgucagagauaucccuagccggauuuccaucuacuggaccaucgugaaacccggagacauucugcugaucaauagcacaggcaaccucauugcuccucgcggguacuuuaagaucagaucuggaaaguccagcauuaugcggucugacgcccccaucggcaaauguaauagcgagugcaucacgccgaacggcuccauuccuaaugauaagcccuuccagaacgugaaucgcaucaccuauggggcuuguccuagauacgucaaacagaacacacugaaacuugccaccggaaugcggaauguucccgaaaaacaaacacgcggcauuuuuggggcgaucgccggauucauugagaacggcugggaagggaugguggacggaugguauggcuuuagacaccagaauagcgagggcaucgggcaggcugccgaucugaagucuacccaagcugccaucaaccagauuaauggaaaacucaaccggcugaucggcaagacgaacgagaaguuccaccagauugaaaaagaguucuccgaaguggaggggagaauccaggaccuugaaaaguacgucgaggauacaaaaauugaccuguggagcuauaaugccgagcuccugguggcucuggaaaaccaacauaccaucgaucucaccgacucugagaugaauaagcuguuugaacgcacaaagaagcagcuucgggagaacgcggaagauaugggaaauggcugcuucaagauuuaccacaaaugugacaacgccugcaucggguccaucagaaauggcaccuaugaucaugacguuuaccgcgacgaggcucugaacaaucgguuucagauuaagggaguggagcucaaaagcggcuacaaggauuggauccuguggauuucuuucgccaucuccugcuuucuucugugugucgcccuccugggguucauuaugugggcuugccagaaaggaaacaucagauguaauaucugcauuuga

SEQ ID NO: 183610 - RNA, 1701 nt, Artificial Sequence; identical to SEQ ID NO: 183267
  derived and/or modified sequence opt5 from hemagglutinin__InfluenzaA__ABC43486

SEQ ID NO: 183611 - RNA, 1701 nt, Artificial Sequence; identical to SEQ ID NO: 183267
  derived and/or modified sequence opt5 from hemagglutinin__InfluenzaA__ABC43497

SEQ ID NO: 183612 - RNA, 1701 nt, Artificial Sequence; identical to SEQ ID NO: 183306
  derived and/or modified sequence opt5 from hemagglutinin__InfluenzaA__ABC43508

SEQ ID NO: 183613 - RNA, 1701 nt, Artificial Sequence; identical to SEQ ID NO: 183306
  derived and/or modified sequence opt5 from hemagglutinin__InfluenzaA__ABC43519

SEQ ID NO: 183614 - RNA, 1701 nt, Artificial Sequence; identical to SEQ ID NO: 183306
  derived and/or modified sequence opt5 from hemagglutinin__InfluenzaA__ABC43530

SEQ ID NO: 183615 - RNA, 1701 nt, Artificial Sequence
  derived and/or modified sequence opt5 from hemagglutinin__InfluenzaA__ABC43552
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccccgggccgcaucacaguuuccaccaagagaagccaacagacagugauucccaacaucgggucccggccucgcgucagagauauucccucucggaucagcaucuacuggaccauugugaaaccuggagacauccugcugauuaauuccaccggcaaccucaucgcuccccgcggguacuuuaagauuagaagcggaaagucuuccaucaugcggagcgacgccccgaucggcaaauguaauucugagugcauuacaccuaacggcagcauccccaaugauaagccuuuccagaacgugaaucgcauuacguauggggcuugucccagauacgucaaacagaacacccugaaacuugccacaggaaugcggaauguucccgaaaagcaaacccgcggcaucuuuggggcgauugccggauucaucgagaacggcugggaagggaugguggacggaugguauggcuuuagacaccaaaauuccgagggcaucgggcaggcugccgaucugaagucuacacaggcugccauuaaccagaucaauggaaaacucaaccggcugauuggcaagaccaacgagaaguuccaccagaucgaaaaagaguucagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguuugaaagaaccaaaaagcagcuucgggagaacgcggaagauaugggaaauggcugcuucaagaucuaccacaaaugugacaacgccugcaucgggucuauuagaaauggcacauaugaucaugacguuuaccgcgacgaggcucugaacaaucgguuucagaucaagggaguggagcucaaauccggcuacaaggauuggauucuguggaucagcuucgccauuucuugcuuucuucugugugucgcccuccugggguucaucaugugggcuugccagaaaggaaacaucagauguaauauuugcaucuga

SEQ ID NO: 183616 - RNA, 1701 nt, Artificial Sequence
  derived and/or modified sequence opt5 from hemagglutinin__InfluenzaA__ABC46554
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacucuccgcaccggauccuggaugggaagaacuguacccuuaucgacgcccugcucggagauccccauugcgacggcuuccagaaugagaaaugggaucuguuugucgaacgcagcaaggccuucuccaacuguuauccuuacgacgugcccgauuaugcuucucugagaagccucguugccuccagcgggacgcuggaguuuauuaaugaaggauucaacuggaccggcgugacacaagacggcgggucuuacgcuugcaaacggggaccugauaauuccuuuuucagccgccuuaacuggcuguauaagucugaguccaccuaccccguccucaaugugacaaugccuaacaaugacaacuuugauaagcuguauaucuggggcguucaccauccgagcaccgacaaagagcagacgaaccuuuacgugcaggccucugggagagucacaguguccaccaagcggagccagcaaacaauuauccccaaugugggaucccgcccuugggucagaggccugucuagccggauuuccaucuacuggaccauuguuaaacccggggacauccuccugaucaacagcaauggaaaccugauugcgccucgcggcuauuucaagaucagaaccggcaaaucuuccauuaugcggagcgaugcccccaucgggacauguucuagcgaaugcauuacgccgaauggauccaucccuaacgacaagcccuuucagaaugugaacaagaucaccuacggcgcuuguccuaaauaugugaagcagaauacacucaaacuggccaccgggaugcgcaacguccccgagaagcagacaagaggaauuuucggcgcuaucgccggguuuauugaaaauggaugggagggcaugaucgauggcugguacggguuccggcaccaaaacucugagggaaccggccaggcggccgaccuuaaaagcacgcaggcugccauugaucaaaucaaugggaagcugaaccgcgugaucgagaaaacaaaugaaaaguuccaccagauugaaaaggaguuuuccgaaguugagggaagaauccaggaccucgagaaauauguggaagauaccaagauugaccuguggagcuacaacgcugagcuucuggucgcccucgaaaaccagcauaccaucgaucugacagacucugagaugaauaaacuguucgaaaagacccggagacaacuccgcgagaacgccgaggauaugggcaaugggugcuuuaaaauuuaucacaagugugacaacgcuugcaucggcuccauucggaauggaacauacgaccaugauguguacagagacgaagcgcugaacaaucgcuuccagaucaagggcguugagcuuaaaagcggguauaaggauuggauccuguggauuucuuuugccaucuccugcuuccuccugugugugguccuucugggauuuauuaugugggcuugccagaaaggcaacauccgguguaauauuugcaucuga

SEQ ID NO: 183617 - RNA, 1701 nt, Artificial Sequence
  derived and/or modified sequence opt5 from hemagglutinin__InfluenzaA__ABC46576
augaagaccaucauugcccugagcuacaucuucugccucguguuugcucagaaccugcccggcaaugacaaauccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccuggucgacgcccuccugggagauccccauugcgacggcuuccagaacgagaagugggaucuguuuguggaacgcagcaaagccuucuccaauuguuauccuuacgacguucccgauuaugcuucucucagaagccugguggccuccagcgggacgcuugaguuuaucaacgaaucuuucaauuggaccggagucacacaguccggcggcagcuacgcuugcaagcgggggucugacaacuccuuuuucagccgccugaauuggcucuaugagucugaguccaaguacccugugcugaacguuaccaugcccaauaacggaaauuuugauaaacuuuauauuuggggcgugcaccauccuagcacagacaaggaacaaaccaaccuguacgucagagccuccgggcgggugacggugucuacaaaacgcagccagcagaccaucauuccgaacaucggauccagacccuggguccggggccucagcucucgcauuuccaucuacuggacaauuguuaagccuggggauauccugcugaucaauagcaacggaaaucucauugcgcccagaggcuauuucaaaauccggaccggcaagucuagcauuaugcgcuccgacgccccuaucgggaccuguucuagcgagugcauuacacccaacggauccaucccgaaugacaagccuuuucagaacgugaauaaaaucacguacggcgcuugucccaaguaugugaaacaaaacacccugaagcuggccacagggaugagaaaugucccugaaaaacagacccggggaauuuucggcgcuaucgccggguuuauugagaacggaugggagggcaugguggauggcugguacggguuccgccaccagaauagcgaaggaacaggccaggcggccgaccugaagucuacccaagcugccaucgaucagauuaacgggaaacucaauagaguuaucgagaagacgaacgaaaaguuccaccagaucgagaaagaauuuuccgagguggagggacggauucaagaccuggaaaaguaugucgaggauacaaaaaucgaccuuuggagcuacaaugcugaacugcucguggcccuggagaaccagcauaccauugaucugaccgacucugaaaugaacaaacucuucgagaagacaagacgccagcugcgggagaaugccgaagauaugggcaacgggugcuuuaagaucuaucacaagugugacaaugcuugcauuggcuccaucagaaacggaaccuacgaucaugacguuuaccgcgacgaggcgcuuaauaaccgguuccagauuaaaggcguggaacuuaagagcggguauaaagauuggauccucuggaucuccuuugccauuucuugcuuccugcuuugugucgugcugcucggauuuaucaugugggcuugccaaaagggcaauauuagauguaacaucugcauuuga

SEQ ID NO: 183618 - RNA, 1701 nt, Artificial Sequence; identical to SEQ ID NO: 183476
  derived and/or modified sequence opt5 from hemagglutinin__InfluenzaA__ABC50167

SEQ ID NO: 183619 - RNA, 1701 nt, Artificial Sequence; identical to SEQ ID NO: 183476
  derived and/or modified sequence opt5 from hemagglutinin__InfluenzaA__ABC50178

SEQ ID NO: 183620 - RNA, 1701 nt, Artificial Sequence; identical to SEQ ID NO: 183476
  derived and/or modified sequence opt5 from hemagglutinin__InfluenzaA__ABC50189

SEQ ID NO: 183621 - RNA, 1701 nt, Artificial Sequence; identical to SEQ ID NO: 183586
  derived and/or modified sequence opt5 from hemagglutinin__InfluenzaA__ABC50200

SEQ ID NO: 183622 - RNA, 1701 nt, Artificial Sequence; identical to SEQ ID NO: 183586
  derived and/or modified sequence opt5 from hemagglutinin__InfluenzaA__ABC50211

SEQ ID NO: 183623 - RNA, 1701 nt, Artificial Sequence; identical to SEQ ID NO: 183586
  derived and/or modified sequence opt5 from hemagglutinin__InfluenzaA__ABC50222

SEQ ID NO: 183624 - RNA, 1701 nt, Artificial Sequence; identical to SEQ ID NO: 183586
  derived and/or modified sequence opt5 from hemagglutinin__InfluenzaA__ABC50233

SEQ ID NO: 183625 - RNA, 1701 nt, Artificial Sequence; identical to SEQ ID NO: 183586
  derived and/or modified sequence opt5 from hemagglutinin__InfluenzaA__ABC50244

SEQ ID NO: 183626 - RNA, 1701 nt, Artificial Sequence; identical to SEQ ID NO: 183586
  derived and/or modified sequence opt5 from hemagglutinin__InfluenzaA__ABC50266

SEQ ID NO: 183627 - RNA, 1701 nt, Artificial Sequence; identical to SEQ ID NO: 183586
  derived and/or modified sequence opt5 from hemagglutinin__InfluenzaA__ABC50277

SEQ ID NO: 183628 - RNA, 1701 nt, Artificial Sequence
  derived and/or modified sequence opt5 from hemagglutinin__InfluenzaA__ABC50299
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccagauuaagggcguggagcugaaauccggauauaaggauuggguucuuuggaucagcuuugccacauccugcuuccugcucuguaucgugcugcugggcuuuauuaugugggccugccagaaagggaauaucagauguaacauuugcaucuga

SEQ ID NO: 183629 - RNA, 1701 nt, Artificial Sequence; identical to SEQ ID NO: 183586
  derived and/or modified sequence opt5 from hemagglutinin__InfluenzaA__ABC50310

SEQ ID NO: 183630 - RNA, 1701 nt, Artificial Sequence
  derived and/or modified sequence opt5 from hemagglutinin__InfluenzaA__ABC50321
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccuggcaaacaaacccgcgggauuuucggagcgaucgccggcuuuauugagaaugggugggaaggaaugauggacggcugguacggcuucagacaccagaacuccgaggggacaggacaggcugccgaucucaagagcacccaagcugccaucaaucagauuaacggcaaacugaaucggcuuaucgagaagacaaacgaaaaguuucaucagaucgagaaagaguucucugaaguggaagggcgcauucaggaccuggagaaguauguugaggauaccaaaaucgaccucugguccuacaaugccgaacugcugguggcucucgagaaccaacacacgauugaucugacagacagcgaaaugaacaaacuuuucgagagaaccaagaagcagcugcgggaaaaugcggaggauaugggaaacggcugcuuuaagaucuaucauaaaugugacaaugccugcauugggucuaucagaaacggcaccuacgaucacgacgucuaccgcgacgaggcucucaauaaccgguuccagauuaagggaguggaacugaaauccggcuauaaggauuggguucuuuggaucagcuuugccaucuccugcuuccugcucuguauugugcugcugggguuuaucaugugggccugccagaaaggaaauauuagauguaacaucugcauuuga

SEQ ID NO: 183631 - RNA, 1701 nt, Artificial Sequence
  derived and/or modified sequence opt5 from hemagglutinin__InfluenzaA__ABC50332
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgggaagccuuuucagaaugugaaccgcaucaccuacggagcuugucccagauaugugaaacagaauacacuuaagcuggccacgggcaugcggaacgucccugagaaacaaacccgcgggauuuucggagcgaucgccggcuuuauugaaaaugggugggagggaaugauggauggcugguacggcuucagacaccagaacuccgaggggacaggacaggcugccgaccucaagagcacccaagcugccaucaaucagauuaacggcaaacugaaucggcuuaucgaaaagacaaacgagaaguuucaucagaucgaaaaagaguucucugaaguggaggggcgcauucaggaucuggagaaguauguugaagacaccaaaaucgaucucugguccuacaaugccgagcugcugguggcucucgaaaaccaacacacgauugaccugacagauagcgagaugaacaaacuuuucgaaagaaccaagaagcagcugcgggagaaugcggaggacaugggaaacggcugcuuuaagaucuaucauaaaugugauaaugccugcauugggucuaucagaaacggcaccuacgaccacgaugucuaccgcgacgaagcucucaauaaccgguuccagauuaagggaguggagcugaaauccggcuauaaggacuggauccuuuggaucagcuuugccauuuccugcuuccugcucuguaucguucugcugggguuuauuaugugggccugccagaaaggaaauaucagauguaacauuugcaucuga

SEQ ID NO: 183632 - RNA, 1701 nt, Artificial Sequence; identical to SEQ ID NO: 183586
  derived and/or modified sequence opt5 from hemagglutinin__InfluenzaA__ABC50343

SEQ ID NO: 183633 - RNA, 1701 nt, Artificial Sequence
  derived and/or modified sequence opt5 from hemagglutinin__InfluenzaA__ABC50354
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcucuugcaaaagacgguccgacaagagcuuuuucucucgccucaacuggcugcaccagcuuaaguauaaauacccugcucugaaugugaccaugcccaacaaugagaaguuugauaaacucuauauuuggggcguucaucacccugggacagacuccgaucagaucagccuguacgcccaggcguccggaagagugaccgucucuacgaagcggagccaacagacagugauuccgaacaucggcucccgccccugggugagaggggucagcucucggauuuccaucuacuggaccauuguuaaaccuggagacauccugcucaucaacagcacaggcaaucugauugcccccagaggguauuucaagaucagaucuggaaagagcuccauuaugcggucugacgcuccuaucggcaaauguaacagcgaaugcauuacccccaauggcuccaucccgaacgauaagccuuuucagaaugugaaccgcaucaccuacggggccugucccagauaugugaaacagaauacacuuaagcuggcuacgggaaugcggaacgucccugagaaacaaacccgcggcauuuucggggccaucgcgggauuuauugaaaauggcugggaggggaugauggacggaugguacggcuucagacaccagaacagcgagggcacagggcaggccgcugaucucaagucuacccaagccgcuaucaaucagauuaacggaaaacugaaucggcuuaucgaaaagacaaacgagaaguuucaucagaucgaaaaagaguucuccgaaguggagggccgcauucaggaccuggagaaguauguugaagauaccaaaaucgaccucuggagcuacaaugccgagcugcugguggcccucgaaaaccaacacacgauugaucugacagacucugagaugaacaaacuuuucgaacgcaccaagaagcagcugcgggagaaugcugaggauauggggaacggaugcuuuaagaucuaucauaaaugugacaaugcgugcauuggcuccaucagaaacgggaccuacgaucacgacgucuaccgcgacgaagcccucaauaaccgguuccagauuaagggcguggagcugaaaagcggauauaaggauuggguucuuuggaucuccuuugcuaucucuugcuuccugcucuguauugugcugcugggcuuuaucaugugggccugccagaaagggaauauuagauguaacaucugcauuuga

SEQ ID NO: 183634 - RNA, 1701 nt, Artificial Sequence
  derived and/or modified sequence opt5 from hemagglutinin__InfluenzaA__ABC50376
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaccggcagccgccccugggugagaggggucuccagccggaucucuauuuacuggacaaucguuaaaccuggagacauucugcucaucaacuccaccggcaaucugaucgcuccccgcggguauuucaagauuagaagcggaaagucuagcaucaugcgguccgacgccccuauuggcaaauguaacucugaaugcaucacccccaauggcagcauuccgaacgauaagccuuuucagaaugugaaccgcaucacauacggggcuugucccagauaugugaaacagaauacgcuuaagcuggccaccggaaugcggaacgucccugagaaacaaacacgcggcaucuucggggcgauugccggauuuaucgaaaauggcugggaggggaugauggacggaugguacggcuucagacaccagaacuccgagggcaccgggcaggcugccgaucucaagagcacacaagcugccauuaaucagaucaacggaaaacugaaucggcuuauugaaaagaccaacgagaaguuucaucagaucgaaaaagaguucucugaaguggagggcagaauccaggaccuggagaaguauguugaagauacgaaaauugaccucugguccuacaaugccgagcugcugguggcucucgaaaaccaacacacaaucgaucugaccgacagcgagaugaacaaacuuuucgaacgcaccaagaagcagcugcgggagaaugcggaggauauggggaacggaugcuuuaagauuuaucauaaaugugacaaugccugcaucggcucuauuagaaacgggacauacgaucacgacgucuaccgcgacgaagcucucaauaaccgguuccagaucaagggcguggagcugaaauccggauauaaggauuggguucuuuggauuagcuuugccaucuccugcuuccugcucuguaucgugcugcugggcuuuauuaugugggccugccagaaagggaauaucagauguaacauuugcaucuga

SEQ ID NO: 183635 - RNA, 1701 nt, Artificial Sequence
  derived and/or modified sequence opt5 from hemagglutinin__InfluenzaA__ABC50387
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauguuuggggcgugcaucacccugggacagacucugaucagauuucccuguacgcgcaggccagcggaagagucaccguguccacgaagcggucucaacagacagugaucccgaacauuggcagccgccccugggucagagggguuuccagccggaucucuauuuacuggaccaucgugaaaccuggagacauucugcucaucaacuccacaggcaaucugaucgcuccccgcggguauuucaagauuagaagcggaaagucuagcaucaugcgguccgacgccccuauuggcaaauguaacucugaaugcaucacccccaauggcagcauuccgaacgauaagccuuuucagaaugugaaccgcaucaccuacggggcuugucccagauaugucaaacagaauacacuuaagcuggccacgggaaugcggaacgugccugagaaacaaacccgcggcaucuucggggcgauugccggauuuaucgaaaauggcugggaggggaugauggacggaugguacggcuucagacaccagaacuccgagggcacagggcaggcugccgaucucaagagcacccaagcugccauuaaucagaucaacggaaaacugaaucggcuuauugaaaagacaaacgagaaguuucaucagaucgaaaaagaguucucugaaguugagggcagaauccaggaccuggagaaguauguggaagauaccaaaauugaccucugguccuacaaugccgagcugcuggucgcucucgaaaaccaacacacgaucgaucugacagacagcgagaugaacaaacuuuucgaacgcaccaagaagcagcugcgggagaaugcggaggauauggggaacggaugcuuuaagauuuaucauaaaugugacaaugccugcaucggcucuauuagaaacgggaccuacgaucacgacguguaccgcgacgaagcucucaauaaccgguuccagaucaagggcguugagcugaaauccggauauaaggauugggugcuuuggauuagcuuugccaucuccugcuuccugcucuguaucguccugcugggcuuuauuaugugggccugccagaaagggaauaucagauguaacauuugcaucuga

SEQ ID NO: 183636 - RNA, 1701 nt, Artificial Sequence
  derived and/or modified sequence opt5 from hemagglutinin__InfluenzaA__ABC50409
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaucugaaguuuaaauauccugcucuuaaugugaccaugcccaacaacgagaaguucgacaaacuguacaucuggggaguucaccauccugggacggauaaugaccagauuucucucuaugcccaggcguccggccgcaucacagugagcaccaagagaucccaacagacagucauuccgaacaucgggucucggccccgcgugagagauauuccuagccggaucuccaucuacuggaccauugugaaacccggagacauccugcugauuaauagcaccggcaaccucaucgccccucgcggguacuuuaagauuagaucuggaaaguccagcaucaugcggucugacgcucccaucggcaaauguaauagcgagugcauuacaccgaacggcuccaucccuaaugauaagcccuuccagaacgucaaucgcauuacguauggggccuguccuagauacguuaaacagaacacccugaagcuggcuacaggaaugcggaaugugcccgaaaaacaaacccgcggcaucuuuggggccauugcgggauucaucgagaacggcugggaagggaugguggacggaugguauggcuuuagacaccaaaauucugagggcaucgggcaggccgcugaucuuaagagcacacaggccgcuauuaaccagaucaauggaaaacucaaccggcugauuggcaagaccaacgagaaguuccaccagaucgaaaaagaguucuccgaagucgaggggcgcauucaggaccuugaaaaguacguggaggauacgaaaaucgaccuguggagcuauaaugccgagcuccugguugcccuggaaaaccaacauacaauugaucucaccgacucugagaugaauaagcuguuugaaagaaccaaaaagcagcuucgggagaacgcugaagauaugggaaauggcugcuucaagaucuaccacaaaugugacaacgcgugcaucggguccauuagaaauggcacauaugaucaugacguguaccgcgacgaggcccugaacaaucgguuucagaucaagggagucgagcucaaaagcggcuacaaggauuggauucuguggaucucuuucgcuauuuccugcuuucuucuguguguggcccuccugggguucaucaugugggccugccagaaaggaaacaucagauguaauauuugcaucuga

SEQ ID NO: 183637 - RNA, 1701 nt, Artificial Sequence; identical to SEQ ID NO: 183636
  derived and/or modified sequence opt5 from hemagglutinin__InfluenzaA__ABC50420

SEQ ID NO: 183638 - RNA, 1701 nt, Artificial Sequence
  derived and/or modified sequence opt5 from hemagglutinin__InfluenzaA__ABC54668
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggauccggccccugggugcgcggggugagcucuagaauuuccaucuacuggaccauugucaaaccuggagauauccugcucaucaauagcacaggcaaccugauugcuccccggggguauuucaagauccgcucuggaaagagcuccauuaugagaucugacgccccuaucggcaaauguaauagcgaaugcauuacccccaacggcucccuuccgaaugacaagccuuuucagaacguuaaucggaucaccuacggggccuguccccgcuaugugaaacagaacacacugaagcucgcgacgggaaugagaaaugugccugagaaacaaacccggggcaucuucggggccauugcuggauuuaucgaaaacggcugggaggggauggucgauggaugguacggcuuccgccaccagaauagcgagggcacagggcaggccgcugaccugaagucuacccaagccgccauuaaccagaucaauggaaaacuuaacagacugauugaaaagacaaaugagaaguuucaucagaucgaaaaagaguucuccgaaguggagggccggauccaggaucucgagaaguauguugaagacaccaaaauugaucuguggagcuacaacgcugagcugcucguggcgcuggaaaaccaacacacgaucgaccuuacagauucugagaugaauaagcuguucgaaagaaccaaaaagcagcuccgcgagaacgccgaggacauggggaauggaugcuuuaagauuuaucauaaaugugauaacgcuugcaucggcuccauucggaaugggaccuacgaccacgaugucuacagagacgaagcccugaacaaucgcuuccagaucaagggcguggagcuuaaaagcggauauaaggacuggauucuguggaucuccuuugccaucucuugcuuccuccuguguguugugcugcucggcuuuauuaugugggcuugccagaaagggaacauccgguguaauauuugcaucuga

SEQ ID NO: 183639 - RNA, 1701 nt, Artificial Sequence
  derived and/or modified sequence opt5 from hemagglutinin__InfluenzaA__ABC54679
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcccgacaggcgggaucugcgacucuccccaccagauccuugauggagagaauuguacccugauugacgcccuccugggcgauccucagugcgacggguuucaaaacaaaaagugggaucuguucaucgaaagaucuaaagccuauagcaauuguuaccccuaugacgucccugauuacgcuucccuccggucucugguggccagcuccggaacgcuugaguuuaacaaugagagcuucaacuggaccggcguuacacagaauggcaccucuuccgcuugcaagcgcagaagcaacaauuccuuuuucucccggcugaacuggcucacacaucugaaguuuaaauaucccgcccuuaaugugaccaugccuaacaacgaaaaguucgacaaacuguacauuuggggaguccaccauccggggacggauaaugaccagaucagccucuaugcgcaggccucuggccgcauuacaguguccaccaagagaagccaacagacaguuauccccaacguggggucccggccucgcgucagagauauucccucucggaucagcaucuacuggaccauugugaaaccuggagacauccugcugauuaauuccaccggcaaccucaucgcuccccgcggguacuuuaagauuagaagcggaaagucuuccaucaugcggagcgacgccccgaucggcaaauguaauucugagugcauuacaccuaacggcagcauccccaaugauaagccuuuccagaacgugaaucgcauuacguauggggcuugucccagauacgucaaacagaacacccugaaacuugccacaggaaugcggaauguucccgaaaagcaaacccgcggcaucuuuggggcgauugccggauucaucgagaacggcugggaagggaugguggacggaugguauggcuuuagacaccaaaauuccgagggcaucgggcaggcugccgaucugaagucuacacaggcugccauuaaccagaucaauggaaaacucaaccggcugauuggcaagaccaacgagaaguuccaccagaucgaaaaagaguucagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguuugaaagaaccaaaaagcagcuucgggagaacgcggaagauaugggaaauggcugcuucaagaucuaccacaaaugugacaacgccugcaucgggucuauuagaaauggcacauaugaucaugacguuuaccgcgacgaggcucugaacaaucgguuucagaucaagggaguggagcucaaauccggcuacaaggauuggauucuguggaucagcuucgccauuucuugcuuucuucugugugucgcccuccugggguucaucaugugggcuugccagaaaggaaacaucagauguaauauuugcaucuga

SEQ ID NO: 183640 - RNA, 1701 nt, Artificial Sequence; identical to SEQ ID NO: 183540
  derived and/or modified sequence opt5 from hemagglutinin__InfluenzaA__ABC67319

SEQ ID NO: 183641 - RNA, 1701 nt, Artificial Sequence
  derived and/or modified sequence opt5 from hemagglutinin__InfluenzaA__ABC67454
augaagaccaucauugcccugagcuacauccucugccugguguucgcucaggagcuucccggcaacgacaauuccacagccacgcugugucucgggcaccaugcggucccuaacggaacccugguuaaaacaauuaccaaugaucaaaucgaagugacaaacgcuaccgagcuugugcagucuagcuccacaggcagaauuugcgacucuccgcaccagauccuggauggggaaaauuguacccucaucgacgcccugcugggagauccccauugcgacggcuuucagaacaaggagugggaucucuucgucgaacggagcaaagccuauuccaauuguuacccuuaugacgugcccgauuacguuucucugcgcagccuuguggcuuccagcgggacgcuggaguuuaacaaugagucuuucaacuggaccggagucgcccaaaauggcacauccagcgcuugcaagagacggucugacaaauccuuuuucagccgccucaacuggcugcaccagcuuaaguauaaguacccugcccugaaugugaccaugcccaacaaugaaaaauuugauaagcucuauauuuggggcguucaucacccugggacagacucugaucagaucucccuguacgcgcaggccagcggaagagugaccgucuccacgaaacggucucaacagacagugauuccgaacaucggcagccgccccugggugagaggggucuccagccggauuucuaucuacuggaccauuguuaagccuggagacauccugcucaucaacuccacaggcaaucugauugcuccccgcggguauuucaaaaucagaagcggaaagucuagcauuaugcgguccgacgccccuaucggcaaguguaacucugagugcauuacccccaauggcagcaucccgaacgauaaaccuuuucagaaugugaaccgcaucaccuacggggcuugucccagauaugugaagcagaauacacuuaaacuggccacgggaaugcggaacgucccugaaaagcaaacccgcggcauuuucggggcgaucgccggauuuauugagaauggcugggaggggaugauggacggaugguacggcuucagacaccagaacuccgaaggcacagggcaggcugccgaucucaaaagcacccaagcugccaucaaucagauuaacggaaagcugaaucggcuuaucgagaaaacaaacgaaaaguuucaucagaucgagaaggaguucucugaaguggagggccgcauucaggaccuggaaaaauauguugaggauaccaagaucgaccucugguccuacaaugccgaacugcugguggcucucgagaaccaacacacgauugaucugacagacagcgaaaugaacaaacuuuucgagagaaccaagaaacagcugcgggagaaugcggaagauauggggaacggaugcuuuaagaucuaucauaagugugacaaugccugcauuggcucuaucagaaacgggaccuacgaucacgacgucuaccgcgacgaggcucucaauaaccgguuccagauuaaaggcguggaacugaaguccggauauaaagauuggguucuuuggaucagcuuugccaucuccugcuuccugcucuguauugugcugcugggcuuuaucaugugggccugccagaaggggaauauuagauguaacaucugcauuuga

SEQ ID NO: 183642 - RNA, 1701 nt, Artificial Sequence; identical to SEQ ID NO: 183586
  derived and/or modified sequence opt5 from hemagglutinin__InfluenzaA__ABC67471

SEQ ID NO: 183643 - RNA, 1701 nt, Artificial Sequence
  derived and/or modified sequence opt5 from hemagglutinin__InfluenzaA__ABC67554
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacggauaacgaccagaucucccucuaugcgcaggccagcggccgcauuacaguguccaccaaaagaucucaacagacaguuaucccgaauauugggagccggccccgcgugagagauaucccuucccggaucagcauuuacuggaccaucgucaagcccggagacauucugcugaucaacucuaccggcaaucucauugcuccucgcggguacuuuaaaaucagauccggaaagagcucuaucaugcggagcgacgcccccauugugaaguguaacuccgaaugcaucacaccgaauggcucuauuccuaacgauaaacccuuccagaaugugaaccgcaucacguauggcgcuuguccuagauacgucaagcagaauacccugaaacuugccacagggaugcggaacguucccgagaagcaaacccgcggaauuuuuggcgcgaucgccggguucaucgaaaauggaugggagggcaugguggacgggugguauggauuuagacaccagaacagcgagggcauuggccaggcugccgaucugaaauccacacaagcugccaucgaccagauuaaugggaagcucaaccggcugaucggaaaaaccaaugaaaaguuccaccagauugagaaggaguucagcgaaguggaaggcagaauccaggaucuugagaaauacgucgaggacacgaagauugaucuguggucuuauaacgccgaacuccugguggcucuggagaaccaacauacaaucgaccucaccgauuccgaaaugaauaaacuguuugagcgcaccaagaaacagcuucgggaaaacgcggaggacauggggaauggaugcuucaagaucuaccacaagugugauaacgccugcauuggcagcaucagaaaugggacauaugaccaugacguuuaccgcgaugaggcucugaacaaucgguuucagauuaaaggcguggaacucaagucuggauacaaagacuggauccuguggauuuccuucgccaucagcugcuuucuucugugugucgcccuccugggcuucaucaugugggcuugccagaaggggaacauuagauguaauaucugcauuuga

SEQ ID NO: 183644 - RNA, 1701 nt, Artificial Sequence
  derived and/or modified sequence opt5 from hemagglutinin__InfluenzaA__ABC67565
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauauuggguuuuucucucggcugaacuggcucuacaaauccggaagcaccuaucccguccugaaugugacgaugccuaacaaugacaacuuugauaaacuuuacaucuggggcguucaccauccgucuacagaccaagagcagaccucccuguaugugcaggcuagcgggcgcgucacagugucuaccaagagaucccagcaaaccauuauccccaacauuggaagccggccuugggugcgcggccucuccucuagaaucagcaucuacuggacaauugucaagcccggcgacauccugguuauuaauuccaacgggaaucugaucgccccucggggauacuucaagaugcgcacgggcaaaagcucuauuaugagauccgaugcgcccaucgggaccuguaucagcgagugcauuacaccgaacggaucuaucccuaaugacaagcccuuucagaacgugaauaaaauuaccuauggcgccuguccuaaguacgugaagcagaacacacucaaacuggcuaccgggaugcggaauguccccgaaaagcagacgcgcggacuuuucggcgccaucgcuggcuuuauugagaacgggugggaaggaaugaucgauggcugguauggguucagacaccaaaauagcgagggaacaggccaggccgcggaccugaaauccacccaggccgcuaucgaucaaauuaacgggaagcucaaucgggugaucgagaaaaccaacgaaaaguuccaccagauugagaaagaauuuucugagguugaaggccgcauccaggaccuggagaaguacguggaggauacaaagauugaccuuuggagcuauaaugccgaacugcucgucgcucuggagaaccagcauaccaucgaucugacagacuccgaaaugaacaaacucuucgagaagacgagacggcaacugagagaaaaugccgaggauaugggaaacggcugcuuuaaaauuuaccacaagugugacaaugccugcaucgggagcauccgcaacggaaccuaugaccaugauguguaccgggacgaggcucuuaauaacagauuccagauuaaaggcguugaacugaagucuggguacaaggauuggauccucuggauuuccuuugcgaucagcugcuuccugcuuugugugguccugcucggauuuauuaugugggccugccagaaaggcaauauccgcuguaacaucugcauuuga

SEQ ID NO: 183645 - RNA, 1701 nt, Artificial Sequence
  derived and/or modified sequence opt5 from hemagglutinin__InfluenzaA__ABC67576
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcgacucuccgcaccggauccuggauggggagaauuguacacucaucgacgcccugcugggagauccccauugcgacggcuuucagaacaaagaaugggaucucuucgucgagcgcagcaaggccuauuccaauuguuacccuuaugacgugcccgauuacgcuucucugagaagccuuguugccuccagcgggacccuggaauuuaacaaugagucuuucaacuggacgggaguggcucagaauggcaccuccuaugccugcaaacggcgcagcauuaaguccuuuuucucuagacucaacuggcugcaccaacuuaaguacaaauauccugcgcugaaugucacaaugcccaacaaugacgaguuugauaagcucuacaucuggggcgugcaucacccuagcaccgacucugaucagacaucccuguacgcccaggcuagcgggcggguuaccguguccacgaaacgcucucagcaaacagucauuccgaacaucggaagcagacccugggugcggggcguguccagccgcauuucuaucuauuggaccauugucaagccuggggacauccugcucaucaacuccacaggaaaucugauugcccccagaggcuacuucaaaauccggagcgggaagucuagcauuaugcgcuccgacgcuccuaucggaaaguguaacucugaaugcauuacccccaauggcagcaucccgaacgauaaaccuuuucagaauguuaacagaaucaccuauggcgccuguccccgguacgugaagcagaauacacuuaaacuggcgacggggaugcgcaacgugccugagaagcagaccagaggaauuuucggcgccaucgcuggguuuauugaaaauggaugggagggcauggucgacgggugguauggauuccggcaccaaaacuccgagggcacaggccaggccgcugaucucaaaagcacccaggccgccaucaaucaaauuaacgggaagcugaauagacuuaucgagaaaacaaacgaaaaguuucaucagaucgaaaaggaguucucugaaguggagggacgcauucaggaccuggagaaauacguugaagauaccaagaucgaccucugguccuauaaugcugagcugcugguggcgcucgaaaaccagcacacgauugaucugacagacagcgagaugaacaaacuuuucgaacggaccagaaagcaacugcgcgagaaugccgaggauaugggcaacgggugcuuuaaaaucuaccauaagugugacaaugcuugcauuggaucuauccggaacggcaccuacgaucacgacgucuauagagacgaagcccucaauaaccgcuuccagauuaaggggguggagcugaaauccggcuacaaggauuggauccuuuggaucagcuuugccauuuccugcuuccugcucuguguugugcugcugggauuuaucaugugggcuugccagaaaggcaauauucgguguaacaucugcauuuga

SEQ ID NO: 183646 - RNA, 1701 nt, Artificial Sequence
  derived and/or modified sequence opt5 from hemagglutinin__InfluenzaA__ABC67587
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguaugggccuugucccagauacgucaaacagaacacccugaagcuggcuacaggaaugcggaauguucccgaaaaacaaacccgcggcaucuuuggggccauugcgggauucaucgagaacggcugggaagggaugguggacggaugguauggcuuuagacaccaaaauucugagggcaucgggcaggccgcugaucuuaagagcacacaggccgcuauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaaucgaccuguggagcuauaaugccgagcuccugguggcccuggaaaaccaacauacaauugaucucaccgacucugagaugaauaagcuguuugaaagaaccaaaaagcagcuucgggagaacgcugaagauaugggaaauggcugcuucaagaucuaccacaaaugugacaacgcgugcaucggguccauuagaaauggcacauaugaucaugacguuuaccgcgacgaggcccugaacaaucgguuucagaucaagggaguggagcucaaaagcggcuacaaggauuggauucuguggaucucuuucgcuauuuccugcuuucuucugugugucgcccuccugggguucaucaugugggccugccagaaaggaaacaucagauguaauauuugcaucuga

SEQ ID NO: 183647 - RNA, 1701 nt, Artificial Sequence; identical to SEQ ID NO: 183267
  derived and/or modified sequence opt5 from hemagglutinin__InfluenzaA__ABC67598

SEQ ID NO: 183648 - RNA, 1701 nt, Artificial Sequence; identical to SEQ ID NO: 183586
  derived and/or modified sequence opt5 from hemagglutinin__InfluenzaA__ABC67609

SEQ ID NO: 183649 - RNA, 1701 nt, Artificial Sequence; identical to SEQ ID NO: 183586
  derived and/or modified sequence opt5 from hemagglutinin__InfluenzaA__ABC67620

SEQ ID NO: 183650 - RNA, 1701 nt, Artificial Sequence; identical to SEQ ID NO: 183586
  derived and/or modified sequence opt5 from hemagglutinin__InfluenzaA__ABC67631

SEQ ID NO: 183651 - RNA, 1701 nt, Artificial Sequence; identical to SEQ ID NO: 183586
  derived and/or modified sequence opt5 from hemagglutinin__InfluenzaA__ABC67642

SEQ ID NO: 183652 - RNA, 1701 nt, Artificial Sequence
  derived and/or modified sequence opt5 from hemagglutinin__InfluenzaA__ABC67653
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccagauuaagggcguggagcugaaauccggauauaaggauuggguucuuuggaucagcuuugccaucuccugcuuccugcucugugugguccugcugggcuuuauuaugugggccugccagaaagggaauaucagauguaacauuugcaucuga

SEQ ID NO: 183653 - RNA, 1701 nt, Artificial Sequence
  derived and/or modified sequence opt5 from hemagglutinin__InfluenzaA__ABC67697
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaagagugggaucuguucgucgaaagaagcaaggccuauuccaauuguuacccuuaugacgugcccgauuacgcuucucuccggagccugguugccuccagcgggacgcuugaguuuaacaaugagucuuucaacuggaccggagugacacagaauggcaccuccagcgcuugcaaacgcagaucuaacaauuccuuuuucagccggcugaacuggcucacacaucugaaguuuaaguauccugcccuuaaugucaccaugcccaacaacgaaaaauucgacaagcuguacaucuggggcgugcaccauccugggacggauaaugaccagauuuuucucuaugcgcaggccucuggacgcaucacaguuuccaccaaaagaagccaacagacagugauuccgaacaucggcucccggccccgcgucagaaauauuccuucucggaucagcaucuacuggaccauugugaagcccggggauauccugcugauuaacuccaccggaaaucucaucgcuccucgcggcuacuucaaaauuagaagcgggaagucuuccaucaugcggagcgacgcccccaucggaaaguguaacucugagugcauuacaccgaauggcagcaucccuaacgacaaacccuuucagaaugugaaccgcauuacguauggcgcuuguccuagauacgucaagcagaauacccugaaacuugccacagggaugcggaacguucccgaaaagcaaacccgcggaaucuucggcgcgauugccggguuuaucgagaauggaugggagggcaugguggaugggugguauggauucagacaccagaacuccgaaggcaucggccaggcugccgaccugaaaucuacacaagcugccauuaaucagaucaacgggaagcucaaccggcugauuggaaaaaccaaugagaaguuccaccagaucgaaaaggaguuuagcgaaguggagggccgcauucaggaucuugagaaauacgucgaagacacgaagaucgaucugugguccuauaacgccgagcuccugguggcucuggaaaaucaacauacaauugaccucaccgauagcgagaugaacaaacuguucgaaagaaccaagaaacagcuucgggagaaugcggaggacauggggaacggaugcuuuaagaucuaccacaagugugauaaugccugcaucggcucuauuagaaacgggacauaugaccaugauguuuaccgcgacgaagcucugaauaaccgguuccagaucaaaggcguggagcucaaguccggauacaaagacuggauucuguggaucagcuuugccauuucuugcuuccuucugugugucgcccuccugggcuuuaucaugugggcuugccagaaggggaauaucagauguaacauuugcaucuga

SEQ ID NO: 183654 - RNA, 1701 nt, Artificial Sequence
  derived and/or modified sequence opt5 from hemagglutinin__InfluenzaA__ABC67708
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccauuucuugcuuccuucugugugucgcccuccugggguuuaucaugugggcuugccagaaaggaaauaucagauguaacauuugcaucuga

SEQ ID NO: 183655 - RNA, 1701 nt, Artificial Sequence; identical to SEQ ID NO: 183654
  derived and/or modified sequence opt5 from hemagglutinin__InfluenzaA__ABC67719

SEQ ID NO: 183656 - RNA, 1701 nt, Artificial Sequence; identical to SEQ ID NO: 183654
  derived and/or modified sequence opt5 from hemagglutinin__InfluenzaA__ABC67733

SEQ ID NO: 183657 - RNA, 1701 nt, Artificial Sequence
  derived and/or modified sequence opt5 from hemagglutinin__InfluenzaA__ABC67806
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcaccaagaaacagcuucgggaaaacgcggaggauaugggaaauggcugcuucaagaucuaucacaagugugacaacgccugcauugggagcaucagaaauggcacauacgaucaugacguguaccgcgacgaggcucugaacaaucgguuucagauuaaaggaguugaacucaagucuggcuauaaagauuggauccuguggauuuccuucgccaucagcugcuuucuucuguguguggcccuccugggguucaucaugugggcuugccagaagggaaacauuagauguaauaucugcauuuga

SEQ ID NO: 183658 - RNA, 1701 nt, Artificial Sequence; identical to SEQ ID NO: 183540
  derived and/or modified sequence opt5 from hemagglutinin__InfluenzaA__ABC67817

SEQ ID NO: 183659 - RNA, 1701 nt, Artificial Sequence; identical to SEQ ID NO: 183654
  derived and/or modified sequence opt5 from hemagglutinin__InfluenzaA__ABC67828

SEQ ID NO: 183660 - RNA, 1701 nt, Artificial Sequence; identical to SEQ ID NO: 183518
  derived and/or modified sequence opt5 from hemagglutinin__InfluenzaA__ABC67839

SEQ ID NO: 183661 - RNA, 1701 nt, Artificial Sequence
  derived and/or modified sequence opt5 from hemagglutinin__InfluenzaA__ABC67850
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggcuagagggguguccagccggauuucuauccacuggaccauugucaaaccuggagacauccugcucaucaacuccacaggcaaucugauugcccccagaggguacuucaagaucagaagcggaaagucuagcauuaugcgguccgacgcuccuaucggcaaauguaacucugaaugcauuacccccaauggcagcaucccgaacgauaagccuuuucagaauguuaaccgcaucaccuauggggccugucccagauacgugaaacagaauacacuuaagcuggcgacgggaaugcggaacgugccugagaaacaaacccgcggcauuuucggggccaucgcuggauuuauugaaaauggcugggaggggaugauggacggaugguauggcuucagacaucagaacuccgagggcacagggcaggccgcugaucucaagagcacccaagccgccaucaaucagauuaacggaaaacugaaucggcuuaucgaaaagacaaacgagaaguuucaccagaucgaaaaagaguucucugaagucgagggccgcauucaggaccuggagaaguacguggaagauaccaaaaucgaccucugguccuauaaugcugagcugcugguugcgcucgaaaaccaacauacgauugaucugacagacagcgagaugaacaaacuuuucgaacgcaccaagaagcagcugcgggagaaugccgaggauauggggaacggaugcuuuaagaucuaccacaaaugugacaaugcuugcauuggcucuaucagaaacgggaccuaugaucacgacguguaccgcgacgaagcccucaauaaccgguuccagauuaagggcgucgagcugaaauccggauacaaggauugggugcuuuggaucagcuuugccaucuccugcuuccugcucuguauuguucugcugggcuuuaucaugugggcuugccagaaagggaauauuagauguaacaucugcauuuga

SEQ ID NO: 183662 - RNA, 1701 nt, Artificial Sequence; identical to SEQ ID NO: 183518
  derived and/or modified sequence opt5 from hemagglutinin__InfluenzaA__ABC67861

SEQ ID NO: 183663 - RNA, 1701 nt, Artificial Sequence; identical to SEQ ID NO: 183586
  derived and/or modified sequence opt5 from hemagglutinin__InfluenzaA__ABC67883

SEQ ID NO: 183664 - RNA, 1701 nt, Artificial Sequence
  derived and/or modified sequence opt5 from hemagglutinin__InfluenzaA__ABC67894
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagcaagcucaacuggcugcaccagcuuaaauauaaguacccugcccugaaugugaccaugcccaacaaugagaaauuugauaagcucuauauuuggggcguucaucacccugggacagacucugaucagaucucccuguacgcgcaggccagcggacgcgugaccgucuccacgaaaagaucucaacagacagugauuccgaacaucggcagccggcccugggugcgcggggucuccagcagaauuucuaucuacuggaccauuguuaagccuggagacauccugcucaucaacuccacaggcaaucugauugcuccccggggguauuucaagauccgcagcggaaaaucuagcauuaugagauccgacgccccuaucggcaaguguaacucugaaugcauuacccccaauggcagcaucccgaacgauaaaccuuuucagaaugugaaccggaucaccuacggggcuuguccccgcuaugugaagcagaauacacuuaaacuggccacgggaaugagaaacgucccugagaagcaaacccggggcauuuucggggcgaucgccggauuuauugaaaauggcugggaggggaugauggacggaugguacggcuuccgccaccagaacuccgagggcacagggcaggcugccgaucucaaaagcacccaagcugccaucaaucagauuaacggaaagcugaauagacuuaucgaaaagacaaacgagaaauuucaucagaucgaaaaggaguucucugaaguggagggccggauucaggaccuggagaaauauguugaagauaccaagaucgaccucugguccuacaaugccgagcugcugguggcucucgaaaaccaacacacgauugaucugacagacagcgagaugaacaaacuuuucgaaagaaccaagaagcagcugcgcgagaaugcggaggauauggggaacggaugcuuuaaaaucuaucauaagugugacaaugccugcauuggcucuauccggaacgggaccuacgaucacgacgucuacagagacgaagcucucaauaaccgcuuccagauuaaaggcguggagcugaaguccggauauaaagauuggguucuuuggaucagcuuugccaucuccugcuuccugcucuguauugugcugcugggcuuuaucaugugggccugccagaaggggaauauucgguguaacaucugcauuuga

SEQ ID NO: 183665 - RNA, 1701 nt, Artificial Sequence; identical to SEQ ID NO: 183586
  derived and/or modified sequence opt5 from hemagglutinin__InfluenzaA__ABC67967

SEQ ID NO: 183666 - RNA, 1701 nt, Artificial Sequence; identical to SEQ ID NO: 183586
  derived and/or modified sequence opt5 from hemagglutinin__InfluenzaA__ABC67978

SEQ ID NO: 183667 - RNA, 1701 nt, Artificial Sequence
  derived and/or modified sequence opt5 from hemagglutinin__InfluenzaA__ABC67989
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaggugaccaugcccaauaacgagaaauuugauaagcucuauauuuggggcguucaucacccugggacagacucugaucagaucucccuguacgcgcaggccagcggaagagugaccgucuccacgaaacggucucaacagacagugauuccgaauaucggcagccgccccugggugagaggggucuccagccggauuucuaucuacuggaccauuguuaagccuggagacauccugcucaucaacuccacaggcaaccugauugcuccccgcggguauuucaagaucagaagcggaaaaucuagcauuaugcgguccgacgccccuaucggcaaguguaauucugaaugcauuacccccaacggcagcaucccgaaugauaaaccuuuucagaacgugaaucgcaucaccuacggggcuugucccagauaugugaagcagaacacacuuaaacuggccacgggaaugcggaaugucccugagaagcaaacccgcggcauuuucggggcgaucgccggauuuauugaaaacggcugggaggggaugauggacggaugguacggcuucagacaccaaaauuccgagggcacagggcaggcugccgaucucaaaagcacccaggcugccaucaaccagauuaauggaaagcugaaccggcuuaucgaaaagacaaaugagaaauuucaucagaucgaaaaggaguucucugaaguggagggccgcauucaggaccuggagaaauauguugaagauaccaagaucgaccucugguccuacaacgccgagcugcugguggcucucgaaaaucaacacacgauugaucugacagacagcgagaugaacaaacuuuucgaaagaaccaagaagcagcugcgggagaacgcggaggauauggggaauggaugcuuuaaaaucuaucauaagugugacaacgucugcauuggcucuaucagaaaugggaccuacgaucacgacguguaccgcgacgaagcccucaacaaucgguuccagauuaaaggcguugagcugaaguccggauauaaagauugggugcuuuggaucagcuuugcuaucuccugcuuccugcucuguauuguccugcugggcuuuaucaugugggccugccagaaggggaacauuagauguaauaucugcauuuga

SEQ ID NO: 183668 - RNA, 1701 nt, Artificial Sequence; identical to SEQ ID NO: 183641
  derived and/or modified sequence opt5 from hemagglutinin__InfluenzaA__ABC68000

SEQ ID NO: 183669 - RNA, 1701 nt, Artificial Sequence
  derived and/or modified sequence opt5 from hemagglutinin__InfluenzaA__ABC68049
augaagaccaucauugcccugagcuacauccucugccugguguucgcucagaaacuucccggcaacgacaauuccacagccacgcugugucucgggcaccaugcggucccuaacggaacccugguuaagacaauuaccgaugaccaaaucgaggugacaaaugcuaccgaacuugugcagucuagcuccacaggcagaauuugcgauucuccgcaccagauccuggacggggagaacuguacccucaucgaugcccugcugggagacccccauugcgauggcuuucagaauaaagaaugggaccucuucgucgagcggagcaaggccuauuccaacuguuacccuuaugaugugcccgacuacguuucucugcgcagccuuguggcuuccagcgggacgcuggaauuuaauaacgagucuuucaauuggaccggagucgcccaaaacggcacauccagcgcuugcaaaagacggucugauaaguccuuuuucagccgccucaauuggcugcaccagcuuaaguauaaauacccugcccugaacgugaccaugcccaauaacgagaaguuugacaaacucuauguuuggggcgugcaucacccugggacagauucugaccagauuucccuguacgcgcaggccagcggaagagucaccguguccacgaagcggucucaacagacagugaucccgaauauuggcagccgccccugggucagagggguuuccagcaaaaucucuauuuacuggaccaucgugaagccuggagacauucugcucaucaacuccacaggcaaccugaucgcuccccggggguauuucaagauucgcagcggaaaaucuagcaucaugagauccgaugccccuauuggcaaguguaauucugaaugcaucacccccaacggcagcauuccgaaugacaaaccuuuucagaacgugaaucggaucaccuacggggcuuguccccgcuaugucaagcagaacacacuuaaacuggccacgggaaugagaaaugugccugagaagcaaacccggggcaucuucggggcgauugccggauuuaucgaaaacggcugggaggggaugauggauggaugguacggcuuccgccaccaaaauuccgagggcacagggcaggcugccgaccucaaaagcacccaggcugccauuaaccagaucaauggaaagcugaacagacuuauugaaaagacaaaugagaaauuucaucagaucgaaaaggaguucucugaaguugagggccggauccaggaucuggagaaauauguggaagacaccaagauugaucucugguccuacaacgccgagcugcuggucgcucucgaaaaucaacacacgaucgaccugacagauagcgagaugaacaaacuuuucgaaagaaccaagaagcagcugcgcgagaacgcggaggacauggggaauggaugcuuuaaaauuuaucauaagugugauaacgccugcaucggcucuauucggaaugggaccuacgaccacgacguguacagagaugaagcucucaacaaucgcuuccagaucaaaggcguugagcugaaguccggauauaaagacugggugcuuuggauuagcuuugccaucuccugcuuccugcucuguaucguccugcugggcuuuauuaugugggccugccagaaggggaacauccgguguaauauuugcaucuga

SEQ ID NO: 183670 - RNA, 1701 nt, Artificial Sequence; identical to SEQ ID NO: 183586
  derived and/or modified sequence opt5 from hemagglutinin__InfluenzaA__ABC68060

SEQ ID NO: 183671 - RNA, 1701 nt, Artificial Sequence
  derived and/or modified sequence opt5 from hemagglutinin__InfluenzaA__ABC68071
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacaaugucuaccgcgacgaagcucucaacaaucgguuccagauuaagggcguggagcugaaauccggauauaaggacuggguucuuuggaucagcuuugccaucuccugcuuccugcucuguauugugcugcugggcuuuaucaugugggccugccagaaagggaacauuagauguaauaucugcauuuga

SEQ ID NO: 183672 - RNA, 1701 nt, Artificial Sequence; identical to SEQ ID NO: 183654
  derived and/or modified sequence opt5 from hemagglutinin__InfluenzaA__ABC68082

SEQ ID NO: 183673 - RNA, 1701 nt, Artificial Sequence
  derived and/or modified sequence opt5 from hemagglutinin__InfluenzaA__ABC68093
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccugggugagaggcgucagcucuauuaucuccauuuacuggaccaucguuaaaccuggggacauccugcucauuaacagcacaggaaaucugaucgcuccccggggcuauuucaagauucgcucuggaaagagcuccaucaugagaucugacgccccuauugggaaauguaacagcgaaugcaucacccccaauggcuccaucccgaacggcaagccuuuucagaaugugaaccggauuaccuacggggcuuguccccgcuaugugaaacagaauacacuuaagcuggccacgggaaugagaaacgucccugagaaacaaacccggggcaucuucggggcgauugccggauuuaucgaaaauggcugggaggggaugauggauggaugguacggcuuccgccaccagaacagcgagggcacagggcaggcugccgaccucaagucuacccaagcugccauuaaucagaucaacggaaaacugaauagacuuaucgaaaagacaaacgagaaguuucaucagauugaaaaagaguucuccgaaguggagggccggauccaggaucuggagaaguauguugaagacaccaaaauugaucucuggagcuacaaugccgagcugcugguggcucucgaaaaccaacacacgaucgaccugacagauucugagaugaacaaacuuuucgaaagaaccaagaagcagcugcgcgagaaugcggaggacauggggaacggaugcuuuaagauuuaucauaaaugugauaaugccugcaucggcuccauucggaacgggaccuacgaccacgaugucuacagagacgaagcucucaauaaccgcuuccagaucaagggcguggagcugaaaagcggauauaaggacuggauccuuuggauuuccuuugccacaucuugcuuccugcucuguaucguucugcugggcuuuauuaugugggccugccagaaagggaauauccgguguaacauuugcaucuga

SEQ ID NO: 183674 - RNA, 1701 nt, Artificial Sequence
  derived and/or modified sequence opt5 from hemagglutinin__InfluenzaA__ABC68222
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugcgcgagaacgccgaggacauggggaauggauguuuuaagaucuaucauaaaugcgauaacgcuugcauuggcucuauccggaaugggaccuacgaccacgaugucuacagagacgaagcccucaacaaucgcuuccagauuaagggcguggagcugaaauccggauauaaggacuggauccuuuggaucagcuuugccauuuccuguuuccugcucugcguugugcugcugggcuuuaucaugugggcuugucagaaagggaacauucggugcaauaucuguauuuga

SEQ ID NO: 183675 - RNA, 1701 nt, Artificial Sequence; identical to SEQ ID NO: 183466
  derived and/or modified sequence opt5 from hemagglutinin__InfluenzaA__ABC68233

SEQ ID NO: 183676 - RNA, 1707 nt, Artificial Sequence
  derived and/or modified sequence opt5 from hemagglutinin__InfluenzaA__ABC72655
auggagaagaucgugcuucucuucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaagcccaacccugcuaaugaucugugcuaccccggagacuucaacgauuaugaggaacugaagcaucuccugucucggaucaaucacuuugagaaaauucagaucauuccuaagagcuccuggucuagccaugaagccuccgugggcguuagcucugugugucccuaccaggggaaauccagcuucuuucgcaacgucguguggcuuaucaagaaaaauucuaccuauccuacaauuaagagauccuacaacaauaccaaccaagaggaccugcucgugcuguggggaauccaccacccgaaugaugccgcugagcagacaaagcuguaucagaaccccaccacguacaucagcgucggcaccucuacacugaaccagcggcucguuccucgcauugccaccagauccaaagugaauggccaaagcgggcggauggaguucuuuuggacaauccugaagcccaacgacgcuauuaauuucgaauccaacggaaauuuuaucgccccugaauacgcguauaaaauugugaagaaaggcgauucuaccaucaugaaaagcgagcuggaauacgggaacugcaauacgaaaugucagacacccaugggagccaucaacuccagcaugccguuccauaauauucacccucucaccaucggcgagugccccaaguaugucaagucuaaccgccuggugcuugcuacagggcugagaaauuccccucagcgggagaaacgcagaaagaaacggggacucuuuggcgccauugcuggcuucaucgaagggggauggcagggcaugguugacgggugguacggauaucaucacagcaacgagcaaggcucuggguacgccgcggacaaggaaagcacccagaaagccauugauggagugaccaauaaggucaacuccaucaucgacaagaugaauacacaguuugaggcugugggccgcgaguucaacaaccuggaaagacggauugagaaucuuaacaaaaagauggaagauggcuuccuggacguuuggacguauaaugccgagcuccuggugcugauggaaaacgagcgcacccucgauuuucacgacucuaaugucaaaaaccuguacgauaaggugagacuucaacugcgggacaaugcuaaagaacucgggaacggauguuucgaguuuuaccauaagugcgauaaugaguguauggaaagcgucagaaacggcacauaugacuacccccaguauuccgaggaagcccgccugaagcgggaggagaucagcggggugaaacuugaaucuauuggaaucuaccagauucuguccaucuauagcaccguugccucuucccucgcucuggcgauuaugguggccggccugagccucuggaugugcuccaaugggucucugcagugcagaaucuguaucuga

SEQ ID NO: 183677 - RNA, 1701 nt, Artificial Sequence; identical to SEQ ID NO: 183267
  derived and/or modified sequence opt5 from hemagglutinin__InfluenzaA__ABC84400

SEQ ID NO: 183678 - RNA, 1701 nt, Artificial Sequence; identical to SEQ ID NO: 183476
  derived and/or modified sequence opt5 from hemagglutinin__InfluenzaA__ABC84411

SEQ ID NO: 183679 - RNA, 1701 nt, Artificial Sequence
  derived and/or modified sequence opt5 from hemagglutinin__InfluenzaA__ABC84433
augaagaccaucauugcccugagcuacauccucugccugguguucgcucagaaacuucccggcaacgacaauagaacagccacgcugugucucgggcaccaugcggucccuaacggaaccauuguuaagacaaucaccaaugaucaaauugaggugacaaacgcuaccgaacuggugcaguccucuagcacaggcgggaucugcgacuccccgcaccagauccuugauggagagaauuguacccugauugacgcccuccugggcgauccccagugcgacggguuucaaaacaaaaagugggaucuguucgucgaacggucuaaagccuauagcaauuguuacccuuaugacgugcccgauuacgcuucccuccgcucucugguugccagcuccggaacgcuugaguuuaacaaugaaucuuucaacuggaccggcgugacacagaauggcaccucuuccgcuugcaagagacggagcaacaauagcuuuuucucccgccugaacuggcucacacaucugaaguuuaaauauccugcccuuaaugucaccaugcccaacaacgagaaguucgacaaacuguacaucuggggagugcaccauccugggacgaauaacgaucagauuagccucuaugcgcaggccucuggcagaaucacaguuuccaccaagcggagccaacagacagugauuccgaauaucgggucccgccccagaguccgggacauuccuucucgcaucagcaucuacuggaccauugugaaacccggagauauccugcugauuaacuccaccggcaaucucaucgcuccuagaggguacuuuaagauucggagcggaaagucuuccaucaugcgcagcgacgcccccaucggcaaauguaacucugagugcauuacaccgaauggcagcaucccuaacgacaagcccuuccagaaugugaacagaauuacguauggggcuuguccucgguacgucaaacagaauacccugaaacuugccacaggaaugcgcaacguucccgaaaagcaaaccagaggcaucuuuggggcgauugccggauucaucgagaauggcugggaagggaugguggauggaugguauggcuuucggcaccagaacuccgagggcaucgggcaggcugccgaccugaagucuacacaagcugccauuaaucagaucaacggaaaacucaacagacugauuggcaagaccaaugagaaguuccaccagaucgaaaaagaguucagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguuugaacggaccaaaaagcagcuuagagagaaugcggaagacaugggaaacggcugcuucaagaucuaccacaaaugugauaaugccugcaucgggucuauucgcaacggcacauaugaccaugauguuuaccgggacgaggcucugaauaacagauuucagaucaagggaguggagcucaaauccggcuacaaggacuggauucuguggaucagcuucgccauuucuugcuuucuucugugugucgcccuccugggguucaucaugugggcuugccagaaaggaaauauccgcuguaacauuugcaucuga

SEQ ID NO: 183680 - RNA, 1701 nt, Artificial Sequence; identical to SEQ ID NO: 183586
  derived and/or modified sequence opt5 from hemagglutinin__InfluenzaA__ABC84444

SEQ ID NO: 183681 - RNA, 1701 nt, Artificial Sequence; identical to SEQ ID NO: 183657
  derived and/or modified sequence opt5 from hemagglutinin__InfluenzaA__ABC84498

SEQ ID NO: 183682 - RNA, 1701 nt, Artificial Sequence; identical to SEQ ID NO: 183657
  derived and/or modified sequence opt5 from hemagglutinin__InfluenzaA__ABC84509

SEQ ID NO: 183683 - RNA, 1701 nt, Artificial Sequence
  derived and/or modified sequence opt5 from hemagglutinin__InfluenzaA__ABC84520
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagagauauuccuucucggaucagcaucuacuggaccauugugaaacccggagacauccugcugauuaauuccaccggcaaccucaucgcuccucgcggguacuucaagauuagaagcggaaagucuuccaucaugcggagcgacgcccccaucggcaaauguaauucugagugcauuacaccgaacggcagcaucccuaaugauaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggacggaugguauggcuucagacaccaaaauuccgagggcaucgggcaggcugccgaucugaagucuacacaggcugccauuaaccagaucaauggaaaacucaaccggcugauuggcaagaccaacgagaaguuccaccagaucgaaaaagaguuuagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguucgaaagaaccaaaaagcagcuucgggagaacgcggaagauaugggaaauggcugcuuuaagaucuaccacaaaugugacaacgccugcaucgggucuauuagaaauggcacauaugaucaugacguuuaccgcgacgaggcucugaacaaucgguuccagaucaagggaguggagcucaaauccggcuacaaggauuggauucuguggaucagcuuugccauuucuugcuuccuucugugugucgcccuccugggguuuaucaugugggcuugccagaaaggaaacaucagauguaauauuugcaucuga

SEQ ID NO: 183684 - RNA, 1701 nt, Artificial Sequence
  derived and/or modified sequence opt5 from hemagglutinin__InfluenzaA__ABC84531
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacuccuuuuucucucgccugaauuggcucuaugagagcgagucuaaguacccugcccugaacgugaccaugcccaauaacggcagauuugacaaacuuuauaucuggggaguucaccauccuuccacagauaaggaacaaaccaaucuguacgugcgggcggccgggcgcgucacggugagcacaaaaagaucccagcagaccgugauuccgaacaucggcucucggcccuggguccgcgggcucagcuccagaauuagcaucuacuggacaauuguuaagccuggagacauccugcugaucaacucuaccggcaaucucauugcuccccggggcuauuucaaaauccgcaccgggaaguccagcauuaugagaucugaugccccuaucggaacauguagcuccgagugcauuacgcccaacggcucuaucccgaaugacaagccuuuucagaacgugaauaaaaucaccuacggggcuuguccccgguaugugaagcaaaacacacugaaacuugccaccggaaugcgcaaugucccugaaaagcagacaagaggcauuuucggggcgaucgccggauuuauugagaacggcugggagggcaugguggacgggugguacggauuccggcaccagaauagcgaaggcaccgggcaggcugccgaucugaaauccacgcaagcugccaucgaccagauuaacggaaagcucaauagacugaucgagaaaacaaacgaaaaguuccaccagaucgagaaggaauuuagcgagguugagggccgcauucaagaucuugaaaaauauguggaggacaccaagaucgaucuguggucuuacaaugccgaacuccuggucgcucuggagaaccagcauaccauugaccucacagauuccgaaaugaauaaacuguucgagaagacccggaaacagcuuagagagaacgcggaagacauggggaacggcugcuuuaagaucuaucacaagugugauaaugccugcauuggaagcauccgcaacggcacauacgaccaugauguguaccgggacgaggcucugaauaacagauuccagauuaaagggguugaacucaagucuggauauaaagacuggauccuguggaucuccuuugccauuagcugcuuccuucugugugugguccuccugggcuuuaucaugugggccugccaaaaggggaauauucgcuguaacaucugcauuuga

SEQ ID NO: 183685 - RNA, 1701 nt, Artificial Sequence; identical to SEQ ID NO: 183674
  derived and/or modified sequence opt5 from hemagglutinin__InfluenzaA__ABC84560

SEQ ID NO: 183686 - RNA, 1701 nt, Artificial Sequence
  derived and/or modified sequence opt5 from hemagglutinin__InfluenzaA__ABC84571
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagaucaucgauggagagaauuguacccugauugacgcccuccugggcgauccccauugcgacggguuucagaacaaagaaugggaucuguucgucgagagaagcaaggccuauuccaauuguuacccuuaugacgugcccgauuacgcuucucuccggagccugguugccuccagcggaacgcuugaauuuaacaaugagucuuucaacuggaccggcguggcucaaaauggcacauccagcgccugcaaacgcagaucuaacaaguccuuuuucagccggcugaauuggcuccaccagcugaaguauaaauacccugcgcuuaacgucaccaugcccaauaacgagaaguuugacaaacuguauaucuggggagugcaucacccuucuacagauuccgaccagauuagccucuacgcccaggcuccggggcgcguuaccguguccacgaagagaucucaacagacagucauccccaacauuggcagccggccuugggugcgcgggguguccagcagaaucucuauuuacuggaccaucgucaaacccggagauauccugcugauuaauuguacaggcaaccucaucgccccucggggguauuucaagauucgcuccggaaagagcucuaucaugagaagcgacgcuuccauuggcaaaugcaauucugaauguaucacccccaacggcagcaucccgaaugacaagccuuuucagaacguuaaucggauuaccuacggggccugcccccgcuaugugaaacagaacacacugaagcuggcgacgggaaugagaaaugugccugagaaacaaacccggggcaucuucggggccauugcuggauuuaucgaaaacggcugggaggggauggucgauggaugguacggcuuccgccaccaaaauuccgagggcacagggcaggccgcugaccuuaagagcacccaggccgccauuaaccagaucaauggaaaacucaacagacugaucgaaaagacaaaugagaaguuucaucagauugaaaaagaguucucugaaguggagggccggauccaggaucuugagaaguauguugaagacaccaaaauugaucugugguccuacaacgcugagcuccugguggcgcuggaaaaccaacacacgaucgaccucacagauagcgagaugaauaagcuguucgaaagaaccaaaaagcagcuucgcgagaacgccgaggacauggggaauggauguuuuaagauuuaucauaaaugcgauaacgcuugcaucggcucuauucggaaugggaccuacgaccacgaugucuacagagacgaagcccugaacaaucgcuuccagaucaagggcguggagcucaaauccggauauaaggacuggauccuguggauuagcuuugccaucuccuguuuccuucugugcguugugcuccugggcuuuauuaugugggcuugucagaaagggaacauccggugcaauauuuguaucuga

SEQ ID NO: 183687 - RNA, 1701 nt, Artificial Sequence; identical to SEQ ID NO: 183674
  derived and/or modified sequence opt5 from hemagglutinin__InfluenzaA__ABC85754

SEQ ID NO: 183688 - RNA, 1701 nt, Artificial Sequence; identical to SEQ ID NO: 183654
  derived and/or modified sequence opt5 from hemagglutinin__InfluenzaA__ABC85765

SEQ ID NO: 183689 - RNA, 1701 nt, Artificial Sequence
  derived and/or modified sequence opt5 from hemagglutinin__InfluenzaA__ABC85776
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuucacaggcaaccugauugccccucggggguauuuuaagauccgcuccggaaagagcucuauuaugagaagcgacgcuuccaucggcaaauguaauucugaaugcauuacccccaacggcagcaucccgaaugacaagccuuuccagaacguuaaucggaucaccuacggggccuguccccgcuaugugaaacagaacacacuuaagcuggcgacgggaaugagaaaugugccugagaaacaaacccggggcauuuuuggggccaucgcuggauucauugaaaacggcugggaggggauggucgauggaugguacggcuuucgccaccaaaauuccgagggcacagggcaggccgcugaccucaagagcacccaggccgccaucaaccagauuaauggaaaacugaacagacuuaucgaaaagacaaaugagaaguuccaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuuugaaagaaccaagaagcagcugcgcgagaacgccgaggacauggggaauggaugcuucaagaucuaucauaaaugugauaacgcuugcauuggcucuauccggaaugggaccuacgaccacgaugucuacagagacgaagcccucaacaaucgcuuucagauuaagggcguggagcugaaauccggauauaaggacuggauccuuuggaucagcuucgccauuuccugcuuucugcucuguguugugcugcugggcuucaucaugugggcuugccagaaagggaacauucgguguaauaucugcauuuga

SEQ ID NO: 183690 - RNA, 1701 nt, Artificial Sequence; identical to SEQ ID NO: 183674
  derived and/or modified sequence opt5 from hemagglutinin__InfluenzaA__ABC85787

SEQ ID NO: 183691 - RNA, 1701 nt, Artificial Sequence; identical to SEQ ID NO: 183657
  derived and/or modified sequence opt5 from hemagglutinin__InfluenzaA__ABC85798

SEQ ID NO: 183692 - RNA, 1701 nt, Artificial Sequence; identical to SEQ ID NO: 183654
  derived and/or modified sequence opt5 from hemagglutinin__InfluenzaA__ABC85820

SEQ ID NO: 183693 - RNA, 1701 nt, Artificial Sequence; identical to SEQ ID NO: 183654
  derived and/or modified sequence opt5 from hemagglutinin__InfluenzaA__ABC85831

SEQ ID NO: 183694 - RNA, 1701 nt, Artificial Sequence; identical to SEQ ID NO: 183657
  derived and/or modified sequence opt5 from hemagglutinin__InfluenzaA__ABC85842

SEQ ID NO: 183695 - RNA, 1701 nt, Artificial Sequence; identical to SEQ ID NO: 183654
  derived and/or modified sequence opt5 from hemagglutinin__InfluenzaA__ABC85853

SEQ ID NO: 183696 - RNA, 1701 nt, Artificial Sequence; identical to SEQ ID NO: 183654
  derived and/or modified sequence opt5 from hemagglutinin__InfluenzaA__ABC85864

SEQ ID NO: 183697 - RNA, 1701 nt, Artificial Sequence; identical to SEQ ID NO: 183657
  derived and/or modified sequence opt5 from hemagglutinin__InfluenzaA__ABC85886

SEQ ID NO: 183698 - RNA, 1701 nt, Artificial Sequence; identical to SEQ ID NO: 183586
  derived and/or modified sequence opt5 from hemagglutinin__InfluenzaA__ABC85908

SEQ ID NO: 183699 - RNA, 1701 nt, Artificial Sequence
  derived and/or modified sequence opt5 from hemagglutinin__InfluenzaA__ABC85919
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccagauuaagggcguggagcugaaauccggauauaaggauuggguucuuuggaucagcuuugccaucuccugcuuccugcucuguauugugcugaugggcuuuaucaugugggccugccagaaagggaauauuagauguaacaucugcauuuga

SEQ ID NO: 183700 - RNA, 1701 nt, Artificial Sequence; identical to SEQ ID NO: 183586
  derived and/or modified sequence opt5 from hemagglutinin__InfluenzaA__ABC85930

SEQ ID NO: 183701 - RNA, 1701 nt, Artificial Sequence; identical to SEQ ID NO: 183635
  derived and/or modified sequence opt5 from hemagglutinin__InfluenzaA__ABC85941

SEQ ID NO: 183702 - RNA, 1701 nt, Artificial Sequence
  derived and/or modified sequence opt5 from hemagglutinin__InfluenzaA__ABC85952
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaaaagugggaucucuucgucgaacggagcaaagccuauuccaauuguuacccuuaugacgugcccgauuacguuucucugcgcagccuuguggcuuccagcgggacgcuggaguuuaacaaugaaucuuucaacuggaccggagucgcccaaaauggcacauccagcgcuugcaagagacggucugacaaguccuuuuucagccgccucaacuggcugcaccagcuuaaauauaaguacccugcccugaaugugaccaugcccaacaaugagaaauuugauaagcucuauauuuggggcguucaucacccugggacagacucugaucagaucucccuguacgcgcaggccagcggaagagugaccgucuccacgaaacggucucaacagacagugauuccgaacaucggcagccgccccugggugagaggggucuccagccggauuucuaucuacuggaccauuguuaagccuggagacauccugcucaucaacuccacaggcaaucugauugcuccccgcggguauuucaagaucagaagcggaaaaucuagcauuaugcgguccgacgccccuaucggcaaguguaacucugagugcauuacccccaauggcagcaucccgaacgauaaaccuuuucagaaugugaaccgcaucaccuacggggcuugucccagauaugugaagcagaauacacuuaaacuggccacgggaaugcggaacgucccugaaaagcaaacccgcggcauuuucggggcgaucgccggauuuauugagaauggcugggaagggaugauggacggaugguacggcuucagacaccauaacuccgagggcacagggcaggcugccgaucucaaaagcacccaggcugccaucaaucaaauuaacggaaagcugaaucggcuuaucgagaagacaaacgaaaaauuucaccagaucgagaaggaguucucugaaguggaaggccgcauucaggaccuggagaaauauguugaggauaccaagaucgaccucugguccuacaaugccgaacugcugguggcucucgagaaccagcauacgauugaucugacagacagcgaaaugaacaaacuuuucgagagaaccaagaagcaacugcgggaaaaugcggaggauauggggaacggaugcuuuaaaaucuaucacaagugugacaaugccugcauuggcucuaucagaaacgggaccuacgaucacgacgucuaccgcgacgaggcucucaauaaccgguuccagauuaaaggcguggaacugaaguccggauauaaagauuggguucuuuggaucagcuuugccaucuccugcuuccugcucuguauugugcugcugggcuuuaucaugugggccugccagaaggggaauauuagauguaacaucugcauuuga

SEQ ID NO: 183703 - RNA, 1701 nt, Artificial Sequence; identical to SEQ ID NO: 183586
  derived and/or modified sequence opt5 from hemagglutinin__InfluenzaA__ABC85974

SEQ ID NO: 183704 - RNA, 1701 nt, Artificial Sequence; identical to SEQ ID NO: 183586
  derived and/or modified sequence opt5 from hemagglutinin__InfluenzaA__ABC85985

SEQ ID NO: 183705 - RNA, 1701 nt, Artificial Sequence
  derived and/or modified sequence opt5 from hemagglutinin__InfluenzaA__ABC85996
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugauggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacguggaggauacgaaaaucgaccuguggagcuauaaugccgagcuccuggucgcucuggaaaaccaacauacaauugaucucaccgacucugagaugaauaagcuguuugaaagaaccaaaaagcagcuucgggagaacgcggaagauaugggaaauggcugcuucaagaucuaccacaaaugugacaacgccugcaucggguccauuagaaauggcacauaugaucaugacguguaccgcgacgaggcucugaacaaucgguuucagaucaagggaguugagcucaaaagcggcuacaaggauuggauucuguggaucucuuucgccauuuccugcuuucuucuguguguggcccuccugggguucaucaugugggcuugccagaaaggaaacaucagauguaauauuugcaucuga

SEQ ID NO: 183706 - RNA, 1701 nt, Artificial Sequence; identical to SEQ ID NO: 183267
  derived and/or modified sequence opt5 from hemagglutinin__InfluenzaA__ABC86007

SEQ ID NO: 183707 - RNA, 1701 nt, Artificial Sequence
  derived and/or modified sequence opt5 from hemagglutinin__InfluenzaA__ABC86018
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguaccauuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucaacuggaccggcgugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggagugcaccauccugggacggauaaugaccagaucucucuguaugcgcaggccuccggccgcauuacaguuagcaccaagagaucccaacagacagugaucccgaacauugggucucggccccgcgucagagauaucccuagccggaucuccauuuacuggaccaucgugaaacccggagacauucuccugaucaauagcaccggcaaccugauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgucaaacagaacacccucaagcuggccacaggaaugcggaauguucccgaaaaacaaacccgcggcauuuuuggggcgaucgccggauucaucgagaacggcugggaagggaugguggacggaugguauggcuuuagacaccaaaauucugagggcauugggcaggcugccgaucuuaagagcacacaggcugccaucaaccagauuaauggaaaacugaaccggcucaucggcaagaccaacgagaaguuccaccagauugaaaaagaguucuccgaaguggaggggagaauccaggaccuggaaaaguacgucgaggauacgaaaauugaccuuuggagcuauaaugccgagcugcucguggcucuggaaaaccaacauacaaucgaucugaccgacucugagaugaauaagcucuuugaacgcaccaaaaagcagcugcgggagaacgcggaagauaugggaaauggcugcuucaagaucuaccacaaaugugacaacgccugcauuggguccaucagaaauggcacauaugaucaugacguuuaccgcgacgaggcucuuaacaaucgguuucagauuaagggaguggagcugaaaagcggcuacaaggauuggauccucuggauuucuuucgccaucuccugcuuucugcuuugugucgcccugcucggguucaucaugugggcuugccagaaaggaaacauuagauguaauaucugcauuuga

SEQ ID NO: 183708 - RNA, 1701 nt, Artificial Sequence; identical to SEQ ID NO: 183267
  derived and/or modified sequence opt5 from hemagglutinin__InfluenzaA__ABC86029

SEQ ID NO: 183709 - RNA, 1701 nt, Artificial Sequence; identical to SEQ ID NO: 183306
  derived and/or modified sequence opt5 from hemagglutinin__InfluenzaA__ABC86040

SEQ ID NO: 183710 - RNA, 1701 nt, Artificial Sequence; identical to SEQ ID NO: 183540
  derived and/or modified sequence opt5 from hemagglutinin__InfluenzaA__ABC86124

SEQ ID NO: 183711 - RNA, 1701 nt, Artificial Sequence; identical to SEQ ID NO: 183617
  derived and/or modified sequence opt5 from hemagglutinin__InfluenzaA__ABC86137

SEQ ID NO: 183712 - RNA, 1701 nt, Artificial Sequence
  derived and/or modified sequence opt5 from hemagglutinin__InfluenzaA__ABC97374
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauucuggguuuuucucccggcugaacuggcucuacaaaagcggaucuaccuaucccguccugaaugugacgaugccuaacaaugacaacuuugauaaacuuuacauuuggggcguucaccauccguccacagaccaagagcagaccagccuguaugugcaggcuucugggcgcgucacaguguccaccaagagaagccagcaaaccaucauucccaacaucggaucccggccuugggugcgcggccucucuagcagaauuuccaucuacuggacaaucgucaagcccggcgacauucugguuaucaauagcaacgggaaucugauugccccucggggauacuucaagaugcgcacgggcaaaucuuccaucaugagaagcgaugcgcccauugggaccuguaucucugagugcaucacaccgaacggaagcauuccuaaugacaagcccuuucagaacgugaauaaaaucaccuauggcgccuguccuaaguacgugaagcagaacacacucaaacuggcuaccgggaugcggaauguccccgaaaagcagacgcgcggacuuuucggcgccauugcuggcuuuaucgagaacgggugggaaggaaugguggauggcugguauggguucagacaccaaaauuccgagggaacaggccaggccgcggaccugaaaucuacccaggccgcuauugaucaaaucaacgggaagcucaaucggguuaucgagaaaaccaacgaaaaguuccaccagauugagaaagaauuuagcgagguggaaggccgcauccaggaccuggagaaguacgucgaggauacaaagauugaccuuugguccuauaaugccgaacugcucguggcucuggagaaccagcauaccaucgaucugacagacagcgaaaugaacaaacucuucgagaagacgagacggcaacugagagaaaaugccgaggauaugggaaacggcugcuuucgcauuuaccacaaaugugacaaugccugcaucgggucuauucggaacggaaccuaugaccaugauguuuacagagacgaggcucuuaauaaccgcuuccagaucaagggcguggaacugaaauccggguacaaggauuggauccucuggauuagcuuugcgaucucuugcuuccugcuuugugucgugcugcucggauuuauuaugugggccugccagaagggcaauauccgguguaacauuugcaucuga

SEQ ID NO: 183713 - RNA, 1701 nt, Artificial Sequence; identical to SEQ ID NO: 183056
  derived and/or modified sequence opt5 from hemagglutinin__InfluenzaA__ABD15449

SEQ ID NO: 183714 - RNA, 1701 nt, Artificial Sequence
  derived and/or modified sequence opt5 from hemagglutinin__InfluenzaA__ABD15460
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccguaucagauucuugauggagagaauuguacccugaucgacgcccuccugggcgauccccagugcgacggguuucaaaacaaaaagugggaucuguucgucgaaagaucuaaagccuacagcaauuguuauccuuacgacgugcccgauuaugcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaccugaaauacaaguauccugcccuuaaugucaccaugcccaacaaugagaaauuugauaagcuguacauuuggggagugcaucacccugggacggacagcgaucagaucucucucuacgcgcaggccuccggccgcauuacaguuagcaccaaaagaucccaacagacagugaucccgaacauugggucucggccccgcgucagagacgugagcucccggaucagcaucuauuggaccauugugaagccuggagacauccugcugauuaacucuaccggcaaucucaucgcuccccgcggguacuucaagauuagauccggaaaaagcucuaucaugcggagcgaugccccuaucggcaaguguaacuccgagugcauuacacccaauggcucuaucccgaacgacaaaccuuuucagaaugucaaccgcauuacguauggggcuugucccagauacguuaagcagaauacccugaaacuugccacaggaaugcggaacgugccugaaaagcaaacccgcggcaucuucggggcgauugccggauuuaucgagaauggcugggaagggaugguggauggaugguauggcuucagacaucagaacagcgagggcacagggcaggcugccgaccugaaauccacccaagcugccaucaaucagauuaacggaaagcucaaucggcugaucggcaagacgaacgagaaauuucaccagauugaaaaggaguucagcgaagucgaggggagaauccaggaucuugaaaaauacguggaggacacaaagauugaucuguggucuuauaaugccgagcuccugguugcucuggaaaaccaacacaccaucgaccucaccgauuccgagaugaacaaacuguucgaacgcacaaagaagcagcuucgggagaaugcggaagacaugggaaacggcugcuuuaaaauuuaccauaagugugauaaugccugcaucgggagcaucagaaacggcaccuacgaccacgacguguaucgcgaugaggcucugaauaaccgguuccagauuaaaggagucgagcucaagucuggcuacaaagacuggauccuguggauuuccuuugccaucagcugcuuccuucuguguguggcccuccugggguuuauuaugugggcuugccagaagggaaauaucagauguaacaucugcauuuga

SEQ ID NO: 183715 - RNA, 1701 nt, Artificial Sequence; identical to SEQ ID NO: 183056
  derived and/or modified sequence opt5 from hemagglutinin__InfluenzaA__ABD15471

SEQ ID NO: 183716 - RNA, 1701 nt, Artificial Sequence; identical to SEQ ID NO: 183056
  derived and/or modified sequence opt5 from hemagglutinin__InfluenzaA__ABD15482

SEQ ID NO: 183717 - RNA, 1701 nt, Artificial Sequence; identical to SEQ ID NO: 183714
  derived and/or modified sequence opt5 from hemagglutinin__InfluenzaA__ABD15493

SEQ ID NO: 183718 - RNA, 1701 nt, Artificial Sequence; identical to SEQ ID NO: 183267
  derived and/or modified sequence opt5 from hemagglutinin__InfluenzaA__ABD15526

SEQ ID NO: 183719 - RNA, 1701 nt, Artificial Sequence; identical to SEQ ID NO: 183476
  derived and/or modified sequence opt5 from hemagglutinin__InfluenzaA__ABD15537

SEQ ID NO: 183720 - RNA, 1701 nt, Artificial Sequence; identical to SEQ ID NO: 183476
  derived and/or modified sequence opt5 from hemagglutinin__InfluenzaA__ABD15548

SEQ ID NO: 183721 - RNA, 1701 nt, Artificial Sequence; identical to SEQ ID NO: 183494
  derived and/or modified sequence opt5 from hemagglutinin__InfluenzaA__ABD15559

SEQ ID NO: 183722 - RNA, 1701 nt, Artificial Sequence; identical to SEQ ID NO: 183476
  derived and/or modified sequence opt5 from hemagglutinin__InfluenzaA__ABD15570

SEQ ID NO: 183723 - RNA, 1701 nt, Artificial Sequence; identical to SEQ ID NO: 183494
  derived and/or modified sequence opt5 from hemagglutinin__InfluenzaA__ABD15581

SEQ ID NO: 183724 - RNA, 1701 nt, Artificial Sequence; identical to SEQ ID NO: 183476
  derived and/or modified sequence opt5 from hemagglutinin__InfluenzaA__ABD15592

SEQ ID NO: 183725 - RNA, 1701 nt, Artificial Sequence; identical to SEQ ID NO: 183476
  derived and/or modified sequence opt5 from hemagglutinin__InfluenzaA__ABD15603

SEQ ID NO: 183726 - RNA, 1701 nt, Artificial Sequence; identical to SEQ ID NO: 183476
  derived and/or modified sequence opt5 from hemagglutinin__InfluenzaA__ABD15614

SEQ ID NO: 183727 - RNA, 1701 nt, Artificial Sequence
  derived and/or modified sequence opt5 from hemagglutinin__InfluenzaA__ABD15625
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccagauuucuaucuacuggaccaucgugaagccuggagacauucugcugaucaacuccaccggcaaucucauugcuccccggggguauuucaagauccgcagcggaaaaucuagcauuaugagauccgaugccccuaucggcaaguguaacucugagugcaucacacccaauggcagcauuccgaacgacaaaccuuuucagaaugucaaccggaucacguacggggcuuguccccgcuauguuaagcaaaauacccugaaacuugccacaggaaugagaaacgugccugaaaagcagacccggggcauuuucggggcgaucgccggauuuauugagaauggcugggaagggaugguggauggaugguacggcuuccgccaccagaacuccgagggcacagggcaagcugccgaccugaaaagcacccaggcugccaucaaucagaucaacggaaagcucaauagacugauuggcaagacgaacgagaaauuucaccagaucgaaaaggaguucucugaagucgaggggcggauucaagaucuugugaaauauguugaagacacaaagaucgaucugugguccuacaaugccgagcuccugguggcucuggagaaccagcauaccauugaccucaccgauagcgaaaugaacaaacuguucgagagaacaaagaagcagcuucgcgaaaaugcggaggacaugggaaacggcugcuuuaaaaucuaucacaagugugauaaugccugcauugggucuauccggaacggcaccuacgaccaugacgucuacagagaugaagcucugaauaaccgcuuccagaucaaaggaguggagcucaaguccggcuauaaagacuggauucuguggaucagcuuugccauuuccugcuuccuucuguguguugcccuccugggguuuaucaugugggcuugccaaaagggaaauauucgguguaacaucugcaucuga

SEQ ID NO: 183728 - RNA, 1701 nt, Artificial Sequence; identical to SEQ ID NO: 183494
  derived and/or modified sequence opt5 from hemagglutinin__InfluenzaA__ABD15636

SEQ ID NO: 183729 - RNA, 1701 nt, Artificial Sequence; identical to SEQ ID NO: 183674
  derived and/or modified sequence opt5 from hemagglutinin__InfluenzaA__ABD15680

SEQ ID NO: 183730 - RNA, 1701 nt, Artificial Sequence
  derived and/or modified sequence opt5 from hemagglutinin__InfluenzaA__ABD15691
augaagaccaucauugcccugagcuacauccucugccugguguucgcucagaaacuucccgucaacgacaaguccacagccacgcugugucucggccaccaugcgguuccuaaugggacccuggugaaaacaauuaccaacgaucacaucgaggugacaaaugcuaccgaacuuguccaaucuagcccgacaggaagaauuugcgacucuccccaucagauccuggauggcgagaacuguacccucaucgacgcccugcugggggauccucacugcgacggauuucagaauaaggaaugggaucucuucguggagcggucuacggccuauagcaacuguuaccccuaugacguuccugauuacgcuucccugcgcucucuuguggccagcuccggcacccuggaauuuaauaacgagagcuucaauuggacaggggucgcucagaacggaaccucuuccgccugcaaaagacggagcauuaaguccuuuuucucccgccucaauuggcugcaucaacuuaaguauaaauaccccgcgcugaacgugacaaugccuaauaacgagaaguuugacaaacucuauaucuggggcguucaccacccgagcaccgauucugaccagauuucccuguacgcccaggcuagcggcagagugacggucuccacaaagcggucucagcaaaccgugauccccaauauugggagccgcccuugggugagaggagucuccagccggaucucuauuuacuggacaaucguuaaacccggcgauauccugcucauuaacuccaccgggaaccugaucgccccucgcggauauuucaagauuagaagcggcaagucuagcaucaugcgguccaaugcucccauugggaaauguaacucugaaugcaucaccccgaauggaagcaucccuaacgacaagcccuuucagaaugugaaccgcauuacauacggcgccuguccuagauaugugaaacagaauacgcuuaagcuggcgaccggcaugcggaacguccccgagaaacagacacgcgggaucuucggagccauugcuggcuuuaucgaaaaugggugggagggaaugguggacggcugguacggguucagacaucaaaacuccgagggaaccggccaggccgcugaucucaagagcacacaggccgccauuaaucaaaucaacggcaaacugaaucggcuuaucgaaaagaccaacgagaaguuucaccagauugaaaaagaguucucugaaguugaggggagaauccaggaccuggagaaguauguggaagauacgaaaauugaccucugguccuacaaugcugagcugcuggucgcgcucgaaaaccagcauacaaucgaucugaccgacagcgagaugaacaaacuuuucgaacgcacccggaagcaacugagagagaaugccgaggauaugggaaacggcugcuuuaagauuuaucacaagugugacaaugcuugcaucgggucuauucgcaacggaacauacgaucacgacguguaccgggaugaagcccucaauaacagauuccagaucaaaggcguugagcugaaguccggguauaaagacuggauccuuuggauuagcuuugccaucuccugcuuccugcucugugugguccugcugggcuuuauuaugugggcuugccagaagggaaauauccgcuguaacauuugcaucuga

SEQ ID NO: 183731 - RNA, 1701 nt, Artificial Sequence
  derived and/or modified sequence opt5 from hemagglutinin__InfluenzaA__ABD15702
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaccagccuguacgcccaggcuccggggcgcguuacgguguccacaaagagaucucaacagaccgucauccccaacauuggcagccggccuugggugcgcgggguguccagcagaaucucuauuuacuggacaaucgucaaacccggagauauucugcucaucaauuguaccggcaaccugaucgccccucggggguauuucaagauucgcuccggaaagagcucuaucaugagaagcgacgcuuccauuggcaaaugcaauucugaauguaucacccccaacggcagcauuccgaaugacaagccuuuucagaacguuaaucggaucacauacggggccugcccccgcuaugugaaacagaacacgcuuaagcuggcgaccggaaugagaaaugugccugagaaacaaacacggggcaucuucggggccauugcuggauuuaucgaaaacggcugggaggggauggucgauggaugguacggcuuccgccaccaaaauuccgagggcaccgggcaggccgcugaccucaagagcacacaggccgccauuaaccagaucaauggaaaacugaacagacuuauugaaaagaccaaugagaaguuucaucagaucgaaaaagaguucucugaaguggagggccggauccaggaucuggagaaguauguugaagacacgaaaauugaucucugguccuacaacgcugagcugcugguggcgcucgaaaaccaacacacaaucgaccugaccgauagcgagaugaauaaacuuuucgaaagaaccaagaagcagcugcgcgagaacgccgaggacauggggaauggauguuuuaagauuuaucauaaaugcgauaacgcuugcaucggcucuauucggaaugggacauacgaccacgaugucuacagagacgaagcccucaacaaucgcuuccagaucaagggcguggagcugaaauccggauauaaggacuggauucuuuggaucagcuuugccaucuccuguuuccugcucugcguugugcugcugggcuuuauuaugugggcuugucagaaagggaacauccggugcaauauuuguaucuga

SEQ ID NO: 183732 - RNA, 1701 nt, Artificial Sequence
  derived and/or modified sequence opt5 from hemagglutinin__InfluenzaA__ABD15724
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucgccaugcccaauaacgagaaguuugacaaacucuauauuuggggagugcaucacccuucuaccgauuccgaccagaucagccuguacgcucaggccccggggcgcguuacaguguccaccaagagaucucaacagacggucauucccaacaucggcagccggccuugggugcgcgggguguccagcagaauuucuaucuacuggacaauugucaaacccggagauauccugcucaucaauuguaccggcaaccugauugcuccucggggguauuucaagauccgcuccggaaagagcucuauuaugagaagcgacgccuccaucggcaaaugcaauucugaauguauuacacccaacggcagcaucccgaaugacaagccuuuucagaacguuaaucggaucaccuacggggcgugcccccgcuaugugaaacagaacacccuuaagcuggccacaggaaugagaaaugugccugagaaacaaacgcggggcauuuucggggcuaucgccggauuuauugaaaacggcugggaggggauggucgauggaugguacggcuuccgccaccaaaauuccgagggcaccgggcaggcugccgaccucaagagcacacaggccgcuaucaaccagauuaauggaaaacugaacagacuuaucgaaaagaccaaugagaaguuucaucagaucgaaaaagaguucucugaaguggagggccggauucaggaucuggagaaguauguugaagacacaaaaaucgaucucugguccuacaacgcggagcugcugguggcccucgaaaaccaacacaccauugaccugacggauagcgagaugaauaaacuuuucgaaagaacaaagaagcagcugcgcgagaacgcugaggacauggggaauggauguuuuaagaucuaucauaaaugcgauaacgccugcauuggcucuauccggaaugggaccuacgaccacgaugucuacagagacgaagcccucaacaaucgcuuccagauuaagggcguggagcugaaauccggauauaaggacuggauccuuuggaucagcuuugcuauuuccuguuuccugcucugcguugugcugcugggcuuuaucaugugggccugucagaaagggaacauucggugcaauaucuguauuuga

SEQ ID NO: 183733 - RNA, 1701 nt, Artificial Sequence
  derived and/or modified sequence opt5 from hemagglutinin__InfluenzaA__ABD15746
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggaaucagcucucggauuuccaucuacuggacaaucgucaagccuggcgauauucugcucaucaacagcaccgggaaucugauugcccccagaggauauuucaaaaucagaucuggcaagagcuccauuaugcggucuaacgcuccuaucgggaaguguaauagcgaaugcaucacccccaacggauccauuccgaaugacaaaccuuuucagaacguuaaucgcaucacauacggcgccugucccagauaugugaagcagaacacgcuuaaacuggcgaccggcaugcggaaugugccugagaagcagacacgcgggauuuucggagccaucgcuggcuuuauugaaaacgggugggagggaauggucgacggcugguacggguucagacaucaaaauagcgagggaaccggccaggccgcugaucucaaaucuacacaggccgccaucaaccaaaucaauggcaagcugaaccggcuuauugagaaaaccaaugaaaaguuucaccagaucgaaaaggaguucuccgaaguggaggggcgcauucaggaccuggagaaauauguugaagauacgaagaucgaccucuggagcuacaacgcugagcugcugguggcgcucgaaaaccagcauacaauugaucugaccgacucugagaugaauaaacuuuucgaacgcacccggaagcaacugagagagaacgccgaggaaaugggaaauggcugcuuuaaaaucuaucacaagugugauaacgcuugcauuggguccauccgcaauggaacauacgaccacgaugucuaccgggacgaggcccucaacaauagauuccagaucaagggcguggaacugaaaagcggguauaaggauuggauucuuuggaucuccuuugccauuucuugcuuccugcucuguguugugcugcugggcuuuaucaugugggcuugccagaaaggaaacauucgcuguaauaucugcaucuga

SEQ ID NO: 183734 - RNA, 1701 nt, Artificial Sequence
  derived and/or modified sequence opt5 from hemagglutinin__InfluenzaA__ABD15757
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgagaaaaccaaugaaaaguuucaccagauugaaaaggaguucuccgaaguugaggggagaauccaggaccuggagaaauauguggaagauacgaagauugaccucuggagcuacaacgcugagcugcuggucgcgcucgaaaaccagcauacaaucgaucugaccgacucugagaugaauaaacuuuucgaacgcacccggaagcaacugagagagaacgccgaggaaaugggaaauggcugcuuuaaaauuuaucacaagugugauaacgcuugcaucggguccauucgcaauggaacauacgaccacgauguguaccgggacgaggcccucaacaauagauuccagaucaagggcguugaacugaaaagcggguauaaggauuggauccuuuggauuuccuuugccaucucuugcuuccugcucugugugguccugcugggcuuuauuaugugggcuugccagaaaggaaacauccgcuguaauauuugcaucuga

SEQ ID NO: 183735 - RNA, 1701 nt, Artificial Sequence; identical to SEQ ID NO: 183674
  derived and/or modified sequence opt5 from hemagglutinin__InfluenzaA__ABD15779

SEQ ID NO: 183736 - RNA, 1701 nt, Artificial Sequence; identical to SEQ ID NO: 183674
  derived and/or modified sequence opt5 from hemagglutinin__InfluenzaA__ABD15790

SEQ ID NO: 183737 - RNA, 1701 nt, Artificial Sequence; identical to SEQ ID NO: 183674
  derived and/or modified sequence opt5 from hemagglutinin__InfluenzaA__ABD16292

SEQ ID NO: 183738 - RNA, 1701 nt, Artificial Sequence; identical to SEQ ID NO: 183657
  derived and/or modified sequence opt5 from hemagglutinin__InfluenzaA__ABD16303

SEQ ID NO: 183739 - RNA, 1701 nt, Artificial Sequence; identical to SEQ ID NO: 183657
  derived and/or modified sequence opt5 from hemagglutinin__InfluenzaA__ABD16325

SEQ ID NO: 183740 - RNA, 1701 nt, Artificial Sequence
  derived and/or modified sequence opt5 from hemagglutinin__InfluenzaA__ABD16336
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacgcuucucuccggagccugauugccuccagcggaacccuugaguuuaacaaugaaucuuucaacuggacaggcguuacccagaauggcacauccagcgcuugcaagcgcagaucuaacuccagcuuuuucucucggcugaauuggcucacccaucugaaguuuaaauauccugcccuuaacgugacgaugcccaauaacgaggaguucgacaagcuguacaucuggggaguccaccauccugggacauauaacgaucagauuucccucuacgcgcaggccagcggccgcaucaccguguccacaaaaagaucucaacagaccguuauuccgaauaucgggagccggccccgcgugagagacauuccuucccggaucagcaucuacuggaccauugucaagcccggagauauccugcugauuaacucuacaggcaaucucaucgcuccucgcggguauuuuaaaauuagauccggaaagagcucuaucaugcggagcgacgcccccaucggcaaguguaacuccgaaugcauuacgccgaauggcucuaucccuaacgacaaacccuuccagaaugugaaccgcauuaccuacggggcuuguccuagauaugugaagcagaauacacugaaacuugccaccggaaugcggaacguccccgagaagcaaacacgcggcaucuuuggggcgauugccggauucaucgaaaauggcugggaggggaugguugauggaugguacggcuuuagacaccagaacagcgagggcaucgggcaggcugccgaccugaaauccacccaagcugccauugaucagaucaauggaaagcucaaccggcugauuggcaaaacgaaugaaaaguuccaccagaucgagaaggaguucagcgaaguggaagggcgcauucaggaccuugagaaauauguggaggauacaaagaucgaccuguggucuuacaacgccgaacuccuggucgcucuggagaaccaacauaccauugaucucaccgacuccgaaaugaauaaacuguuugagagaacaaagaaacagcuucgggaaaacgcggaggauaugggaaauggcugcuucaagaucuaucacaagugugacaacgccugcaucgggagcauuagaaauggcaccuacgaucaugacguguaccgcgacgaggcucugaacaaucgguuucagaucaaaggaguugaacucaagucuggcuauaaagauuggauucuguggaucuccuucgccauuagcugcuuucuucuguguguggcccuccugggguucaucaugugggcuugccagaagggaaacaucagauguaauauuugcaucuga

SEQ ID NO: 183741 - RNA, 1701 nt, Artificial Sequence; identical to SEQ ID NO: 183657
  derived and/or modified sequence opt5 from hemagglutinin__InfluenzaA__ABD16347

SEQ ID NO: 183742 - RNA, 1701 nt, Artificial Sequence
  derived and/or modified sequence opt5 from hemagglutinin__InfluenzaA__ABD16358
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgaccuggaaaugaauaaacuuuuugagcgcaccaagaaacagcugcgggaaaacgcggaggauaugggaaauggcugcuucaagaucuaucacaagugugacaacgccugcauuggguccaucagaaauggcacauacgaucaugacguguaccgcgacgaggcucucaacaaucgguuucagauuaaaggaguugaacuuaagagcggcuauaaagauuggauccuguggauuucuuucgccaucuccugcuuucugcucuguguggcccugcugggguucaucaugugggcuugccagaagggaaacauuagauguaauaucugcauuuga

SEQ ID NO: 183743 - RNA, 1701 nt, Artificial Sequence; identical to SEQ ID NO: 183657
  derived and/or modified sequence opt5 from hemagglutinin__InfluenzaA__ABD16472

SEQ ID NO: 183744 - RNA, 1701 nt, Artificial Sequence; identical to SEQ ID NO: 183657
  derived and/or modified sequence opt5 from hemagglutinin__InfluenzaA__ABD16483

SEQ ID NO: 183745 - RNA, 1701 nt, Artificial Sequence; identical to SEQ ID NO: 183654
  derived and/or modified sequence opt5 from hemagglutinin__InfluenzaA__ABD16494

SEQ ID NO: 183746 - RNA, 1701 nt, Artificial Sequence; identical to SEQ ID NO: 183657
  derived and/or modified sequence opt5 from hemagglutinin__InfluenzaA__ABD16505

SEQ ID NO: 183747 - RNA, 1701 nt, Artificial Sequence
  derived and/or modified sequence opt5 from hemagglutinin__InfluenzaA__ABD16516
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuucaaaacaaaaagugggaucuguucaucgaaagaagcaaagccuauuccaauuguuacccuuaugacguccccgauuacgcuucucugcggagccucguggccuccagcggaacgcuggaguuuaacaaugaaucuuucaacuggaccggcguuacacagaauggcaccuccagcgcuugcaagcgcagaucuaacaauuccuuuuucagccggcuuaacuggcugacacaucucaaguuuaaauauccugcccugaaugugaccaugcccaacaacgagaaguucgacaaacuuuacauuuggggaguccaccauccugggacggauaaugaccagaucucucuguaugcgcaggccuccggccgcauuacagugagcaccaagagaucccaacagacaguuaucccgaacauugggucucggccccgcgugagagauaucccuagccggaucuccauuuacuggaccaucgucaaacccggagacauucuccugaucaauagcaccggcaaccugauugcuccucgcggguacuuuaagaucagaucuggaaaguccagcaucaugcggucugacgcccccauugauaaauguaauagcgagugcaucacaccgaacggcuccauuccuaaugacaagcccuuccagaacgugaaucgcaucacguauggcgcuuguccuagauacgugaaacagaacacccucaagcuggccacagggaugcggaauguccccgaaaaacaaacccgcggaauuuuuggcgcgaucgccggguucaucgagaacggaugggaaggcaugguugaugggugguauggauuuagacaccaaaauucugagggcauuggccaggcugccgaccuuaagagcacacaggcugccaucaaccagauuaaugggaaacugaaccggcucaucggaaagaccaacgagaaguuccaccagauugaaaaagaguucuccgaaguggagggcagaauccaggaucuggaaaaguacguggaggacacgaaagucgaucuuuggagcuauaaugccgagcugcucguggcucuggaaaaccaacauacaauugaccugaccgauucugagaugaauaagcucuuugaacgcaccaaaaagcagcugcgggagaacgcggaagacauggggaauggaugcuucaagaucuaccacaaaugugauaacgccugcaucggcuccauuagaaaugggacauaugaccaugacguuuaccgcgaugaggcucuuaacaaucgguuucagaucaagggcguggagcugaaaagcggauacaaggacuggauucucuggaucucuuucgccauuuccugcuuucugcuuugugucgcccugcucggcuucaucaugugggcuugccagaaagggaacaucagauguaauauuugcaucuga

SEQ ID NO: 183748 - RNA, 1701 nt, Artificial Sequence
  derived and/or modified sequence opt5 from hemagglutinin__InfluenzaA__ABD16527
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggaggcaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgaucaugcuucucuccggagccugguugccuccagcgggacgcuugaauuuaacaaugagucuuucgacuggaccggagugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggcgugcaucacccugggacggacucugaucagauuucccucuaugcgcaggccagcggacgcaucacaguuuccaccaaaagaucucaacagacagugauuccgaacaucggcagccggccccgcgucagagacguguccagccggauuucuaucuacuggaccaucgugaagccuggggacauucugcugaucaacuccaccggaaaucucauugcuccccgcggcuacuucaagaucagaagcgggaaaucuagcauuaugcgguccgaugccccuaucggaaaguguaacucugaaugcaucacacccaauggcagcauuccgaacgacaaaccuuuucagaaugucaaccgcaucacguauggcgcuugucccagauacguuaagcagaauacccugaaacuugccacagggaugcggaacgugccugagaagcaaacccgcggaauuuucggcgcgaucgccggguuuauugaaaauggaugggagggcaugguggaugggugguauggauucagacaccagaacuccgagggcacaggccaggcugccgaccugaaaagcacccaagcugccaucaaucagaucaacgggaagcucaaucggcugauuggaaagacgaacgaaaaauuucaucagaucgagaaggaguucucugaagucgaaggccgcauucaggaucuugagaaauacguggaggacacaaagaucgaucugugguccuauaaugccgaacuccugguugcucuggagaaccaacacaccauugaccucaccgauagcgaaaugaacaaacuguucgagagaacaaagaagcagcuucgggaaaaugcggaggacauggggaacggaugcuuuaaaaucuaccauaagugugauaaugccugcauuggcucuaucagaaacgggaccuaugaccacgacguguaccgcgaugaggcucugaauaaccgguuccagaucaaaggcgucgaacucaaguccggauacaaagacuggauucuguggaucagcuuugccauuuccugcuuccuucuguguguggcccuccugggcuuuaucaugugggcuugccagaaggggaauauuagaugugauaucugcaucuga

SEQ ID NO: 183749 - RNA, 1701 nt, Artificial Sequence; identical to SEQ ID NO: 183540
  derived and/or modified sequence opt5 from hemagglutinin__InfluenzaA__ABD16538

SEQ ID NO: 183750 - RNA, 1701 nt, Artificial Sequence
  derived and/or modified sequence opt5 from hemagglutinin__InfluenzaA__ABD16549
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcaccaagaaacagcuucgggaaaacgcggaggauaugggaaauggcugcuucaagaucuaucacaagugugacaacgccugcauugggagcaucagaaauggcacauacgaucaugacguguaccgcgacgaggcucugaacaaucgguuucagauuaaaggaguugaacucaagucuggcuauaaagauuggauccuguggauuuccuucgccaucagcugcuuucuucuguguguggcccuccugggguucaucgucugggcuugccagaagggaaacauuagauguaauaucugcauuuga

SEQ ID NO: 183751 - RNA, 1701 nt, Artificial Sequence; identical to SEQ ID NO: 183654
  derived and/or modified sequence opt5 from hemagglutinin__InfluenzaA__ABD16560

SEQ ID NO: 183752 - RNA, 1701 nt, Artificial Sequence
  derived and/or modified sequence opt5 from hemagglutinin__InfluenzaA__ABD16571
augaagaccaucauugcccugagcuacaucuucugccucguggucgcucagaaacugcccggcaacgacaauuccacagccacgcuuugucuggggcaccaugcgguuccuaacggaaccauugugaagacaaucaccaaugaucaaauugaggugacaaacgcuaccgaacucguccagucuagcuccacaggcagaaucugcaauucuccgcaccggauccuggacgggaaaaacuguacccuuauugaugcccugcucggagacccccauugcgauagcuuucagaauaaggagugggaccuguucguggaacgcuccaaagccuauucuaacuguuacccuuaugauguucccgacuacgcuagccugagaucccucguggccagcucuggcacgcuggaguuuaucaaugaagauuucaacuggaccggggucgcucaguccggaggcagcuaugccugcaagcggggcucuguuaauuccuuuuucagccgccuuaacuggcugcacgagucugaguacaaguauccugcgcucaaugugacaaugcccaacaaugggaaauuugacaagcuguacauuuggggagugcaucacccuuccaccgauagagaacaaacaaaccuuuacguccgggccagcggccgcgugaccguguccacgaaaagaucucagcagacagucaucccgaacauugggagccggcccuggguucgcggacuguccagcagaaucucuauuuauuggaccaucgugaagccuggcgacauccuccugauuaauuccacagggaaccugaucgcuccccggggauacuucaaaauucgcaccggcaagagcucuaucaugagaagcgaugccccuauuggcaccuguuccucugagugcaucacacccaaugggagcaucccgaacgacaagccuuuucagaaugugaaccggauuacguauggagcuuguccccgcuacgucaaacaaaauacccucaagcuggccacaggcaugagaaacgugccugaaaaacagacccgggggaucuucggagcgauugccggcuuuaucgagaaugggugggagggaaugguugacggcugguauggcuucagacaccagaacuccgaagggacaggacaggcugccgaucuuaagagcacccaagcugccauugaccagaucaauggcaaacugaaccgccucaucgagaagacgaaugaaaaauuucaucagauugagaaggaguucucugaaguggaggggcggauccaagaucuggaaaaguacgucgaggacacaaaaauugaucuuugguccuauaacgccgaacugcucguggcucuggagaaucagcacaccaucgaccugaccgauagcgaaaugaacaaacucuucgagaagacaagaaagcagcugcgcgagaacgcggaagacaugggaaauggcugcuuuaaaauuuaccauaagugugauaacgccugcaucgggucuauucggaauggcaccuacgaccacgauguuuauagagacgaggcucuuaacaaucgcuuccagaucaagggaguggaacugaaauccggcuacaaggacuggauccucuggauuagcuuugccaucuccugcuuccugcuuugugucgugcugcucggguuuauuaugugggccugccaaaaaggaaacauccgguguaauauuugcaucuga

SEQ ID NO: 183753 - RNA, 1701 nt, Artificial Sequence
  derived and/or modified sequence opt5 from hemagglutinin__InfluenzaA__ABD16718
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuuauugaacgcagcaaagccuucuccaauuguuauccuuacgacguccccgauuaugcuucucucagaagccugguggccuccagcgggacgcuugaguuuaucaacgaaggauucaauuggaccggcguuacacagucuggcggguccuacgcuugcaagcggggaagcgugaacuccuuuuucucucgccugaauuggcucuaugagagcgaguacaaguauccugcccugaacgucaccaugcccaauaacggcaaauuugacaagcuguacauuuggggagugcaccauccuaucacagaaaaagagcaaaccaaucuguacguuagagcgucugggcgggugacggucuccacaaagcgcagccagcagaccgugauuccgaacaucggcuccagacccugggugcgggggcucucuagccgcauuuccaucuauuggacaaucgucaaaccuggagauauucugcugaucaacagcaccggcaaucucauugcccccagaggcuacuucaagauccggaccgggaagucuuccauuaugcgcagcgacgcuccuaucggaacauguucuagcgaaugcaucacgcccaacggcuccauuccgaaugauaaaccuuuucagaacguuaauaagaucaccuauggggccugucccagauacgugaaacaaaacacacugaaacuugcuaccggaaugcggaaugugccugagaagcagacacgcggcauuuucggggccaucgcgggauuuauugagaacggcugggaaggcauggucgacgggugguauggauucagacaccaaaauucugagggcaccgggcaggccgcugaccuuaagagcacgcaggccgcuaucgaucagaucaacggaaaacucaaucggcugauugaaaagacaaacgagaaguuccaccagaucgaaaaagaguuuuccgagguggaaggccgcauucaagaccuugagaaguacguugaagauaccaaaaucgaccuguggagcuauaaugccgagcuccugguggcccuggaaaaccagcauaccauugaucucacagacucugagaugaauaagcuguucgagaaaaccagaaagcagcuucgggaaaacgcugaggauauggggaacggcugcuuuaagaucuaccacaaaugugacaaugcgugcauuggauccaucagaaacggcacauacgaucaugacgucuaucgcgaugaagcccugaauaaccgguuccagaucaaggggguggagcucaaaagcggauacaaggacuggauucuguggaucucuuuugcuauuuccugcuuccuucuguguguugugcuccugggcuuuaucaugugggccugccaaaaagggaauauuagauguaacaucugcaucuga

SEQ ID NO: 183754 - RNA, 1701 nt, Artificial Sequence
  derived and/or modified sequence opt5 from hemagglutinin__InfluenzaA__ABD16729
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagaacggcgggucuuauaccugcaagcggggauccgucaauagcuuuuucucucgccugaacuggcucuacgaguccgagagcaaguacccugugcugaauguuacaaugcccaacaauggcaaauuugacaaacuuuauaucuggggagugcaccauccuucuaccgauaaggaacaaacgaaccuguacgucagagcuuccgggaaggugacagugagcaccaaacggucccagcagacagucauuccgaacaucggcucucgccccuggguuagagggcucagcucccggauuagcaucuacuggaccauugugaagccuggagacauccugcugaucaauucuaccggcaaccucauugcgccccgcggcuauuucaagaucagaacagggaaauccagcauuaugcggucugaugccccuaucggaacguguagcuccgagugcauuacccccaauggcucuaucccgaacgacaagccuuuucagaaugugaacaaaaucacauacggggccuguccccgcuaugucaagcaaaauacccugaaacuugcuacaggaaugagaaacgugccugaaaagcagacccggggcauuuucggggccaucgcuggauuuauugagaauggcugggagggcaugguugacgggugguacggauuccgccaccagaacagcgaaggcacggggcaggccgcggaucugaaauccacacaagccgcuaucgaccagauuaauggaaagcucaacagacugaucgagaagaccaaugaaaaauuccaccagaucgagaaggaauuuagcgagguggagggccggauucaagaucuugaaaaauaugucgaggacaccaagaucgaucuguggucuuacaacgccgaacuccugguggcucuggagaaucagcauacaauugaccucaccgauuccgaaaugaacaaacuguucgagaagacaagaaagcagcuucgcgagaacgccgaagacauggggaauggcugcuuuaaaaucuaucacaagugugauaacgccugcauuggaagcauccggaauggcacguacgaccaugauguuuacagagacgaggcucugaacaaucgcuuccagauuaaagggguggaacucaagucuggauauaaagacuggauccuguggaucuccuuugcgauuagcugcuuccuucugugugucgugcuccugggcuuuaucaugugggccugccaaaaggggaacauucgguguaauaucugcauuuga

SEQ ID NO: 183755 - RNA, 1701 nt, Artificial Sequence
  derived and/or modified sequence opt5 from hemagglutinin__InfluenzaA__ABD16751
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcacucuagcuccacaggcaagauuugcgauaauccgcauagaauccuugacgggaucaacuguacccugauugaugcccuccugggagacccccacugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccagaacgugacaaugccuaauaacgacaacuccgauaagcuguacauuuggggaguucaucacccgagcaccgacaaagagcaaacggaccuuuaugugcaggccucuggcaaggucacaguguccaccaaacgcagccagcagacagugauccccaaugucggguccagaccuuggguucggggacugucuagccgcguguccauuuacuggaccaucgugaagcccggcgauauucucgucaucaacagcaauggcaaccugaucgcgccuagaggguacuuuaaaaugcggaccggaaagucuuccauuaugcgcagcgacgcccccaucggcacauguucuagcgagugcauuacgccgaauggguccaucccuaacgauaagcccuuccaaaaugugaacaaaauuaccuauggagcuuguccuaaguacguuaaacagaauacacugaagcucgccaccggcaugagaaacgugcccgaaaaacagacacgggggaucuuuggagcuaucgccggcuucauugagaauggcugggaagggaugaucgacggaugguauggcuuucgccaccagaacucugaggggaccggacaagcggccgaucuuaagagcacgcaggcugccauugaccagaucaauggcaaacugaacagagucauugagaagacaaaugaaaaguuccaucaaaucgagaaagaguucuccgaaguggaagggcggauccaggaucuggagaaguacguugaggacaccaaaauugaucucuggagcuauaacgcugaacugcuuguggcccuggagaaccagcacaccaucgaccucacagauucugaaaugaauaagcuguuugagaaaacccgcagacagcugcgggaaaacgccgaggacaugggcaauggaugcuucaagauuuaccauaagugugacaacgcuugcaucggcuccauuagaaaugggacauaugaucacgacgucuaccgcgaugaggcgcucaacaaucgguuucaaaucaaaggaguggaacuuaagagcggcuacaaagacuggauucuguggaucucuuucgccaucuccugcuuucugcucugugucgugcugcuuggguucauuaugugggcuugccagaagggaaacaucagauguaauauuugcaucuga

SEQ ID NO: 183756 - RNA, 1701 nt, Artificial Sequence; identical to SEQ ID NO: 183617
  derived and/or modified sequence opt5 from hemagglutinin__InfluenzaA__ABD16762

SEQ ID NO: 183757 - RNA, 1701 nt, Artificial Sequence; identical to SEQ ID NO: 183329
  derived and/or modified sequence opt5 from hemagglutinin__InfluenzaA__ABD17323

SEQ ID NO: 183758 - RNA, 1701 nt, Artificial Sequence; identical to SEQ ID NO: 183586
  derived and/or modified sequence opt5 from hemagglutinin__InfluenzaA__ABD38134

SEQ ID NO: 183759 - RNA, 1698 nt, Artificial Sequence; identical to SEQ ID NO: 183325
  derived and/or modified sequence opt5 from hemagglutinin__InfluenzaA__ABD60779

SEQ ID NO: 183760 - RNA, 1701 nt, Artificial Sequence
  derived and/or modified sequence opt5 from hemagglutinin__InfluenzaA__ABD60790
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucaaugaaggcuucacauggaccggcgugacacagaacgggggaagcaaugccugcaagagaggcccugauucuggguuuuucucccggcugaacuggcucuacaaaagcggaucuaccuaucccguccugaaugugacgaugccuaacaaugacaacuuugauaaacuuuacauuuggggcguucaccauccguccacagaccaagagcagaccagccuguaugugcaggcuucugggcgcgucacaguguccaccaagagaagccagcaaaccaucauucccaacaucggaucccggccuugggugcgcggccucucuagcagaauuuccaucuacuggacaaucgucaagcccggcgacauucugaucauuaauagcaacgggaaucugaucgccccucggggauacuucaagaugcgcacgggcaaaucuuccauuaugagaagcgaugcgcccaucgggaccuguaucucugagugcauuacaccgaacggaagcaucccuaaugacaagcccuuucagaacguuaauaaaauuaccuauggcgccuguccuaaguacgugaagcagaacacacucaaacuggcuaccgggaugcggaaugugcccgaaaagcagacgcgcggaaucuucggcgccauugcuggcuuuaucgagaacgggugggaaggaaugaucgauggcugguauggguucagacaccaaaauuccgagggaacaggccaggccgcggaccuuaaaucuacccaggccgcuauugaucaaaucaacgggaagcugaaucggauuaucgagaaaaccaacgaaaaguuccaccagauugagaaagaauuuagcgaggucgaaggccgcauccaggaccucgagaaguacguggaggauacaaagauugaccugugguccuauaaugccgaacuucugguugcucucgagaaccagcauaccaucgaucugacagacagcgaaaugaacaaacuguucgagaagacgagacggcaacucagagaaaaugccgaggauaugggaaacggcugcuuuaaaaucuaccacaagugugacaaugccugcauugggucuauccgcaacggaaccuaugaccaugauguguaccgggacgaggcucugaauaacagauuccagauuaaaggcgucgaacuuaaguccggguacaaggauuggauccuguggauuagcuuugcgaucucuugcuuccuccugugugugguucuucugggauuuaucaugugggccugccagaaaggcaauauucgcuguaacaucugcauuuga

SEQ ID NO: 183761 - RNA, 1701 nt, Artificial Sequence
  derived and/or modified sequence opt5 from hemagglutinin__InfluenzaA__ABD60801
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagacugugcgacucuccgcaccggauucucgaugggaaaaauuguacccugaucgacgcccugcucggagauccccauugcgacggcuuucagaacaaggagugggaucuguucgucgaacgcagcaaagccuauuccaauuguuacccuuaugacgugcccgauuacgcuucucuuagaagccugguugccuccagcgggacgcucgaguuuaucaacgaagacuucaauuggaccggaguggcucaggauggcggcucuuaugccugccggcgcggguccgucaacagcuuuuucucuagacugaauuggcuucacaagcuggaguacaaguauccugcgcucaacgugacaaugcccaauaacggaaaauuugacaagcuguacauuuggggcguucaucacccuuccaccgauagcgaccaaacaucucuguacgugcgggccuccgggcgcgucaccgugagcacgaaaagaucccagcagacagugaucccgaauauuggaucucggcccuggguccgcggccagagcuccagaaugagcaucuauuggaccauuguuaagccuggggacauccuccugauuaacucuacaggaaaccuuaucgcuccccggggcuacuucaaaauccgcaauggcaaguccagcauuaugagaucugaugccccuaucgggaacuguagcuccgagugcauuacccccaauggaucuaucccgaacgacaagccuuuucaaaaugugaaccggauuaccuauggcgcuuguccccgcuacgugaaacagcacacacugaagcucgccacggggaugagaaaugucccugaaaaacagacccggggaaucuucggcgcgaucgccggguuuauugagaacggaugggaaggcaugguggauggcugguauggguucagacaucagaauagcgagggaacaggccaagcugccgaccugaaguccacccaggcugccaucgaucagauuaacgggaaacuuaaucgccugaucgagaagacaaacgaaaaauuucaccaaauugagaaggaguucagcgaaguugaaggacggauccaggaccucgagaaguacguggaggauaccaaaaucgaccuguggucuuauaaugccgaacugcucgucgcucuggagaaccagcauacgauugaucuuacagacuccgaaaugaauaagcuguucgagagaacccgcaaacagcuccgggaaaacgcggaggauaugggcaacgggugcuuuaagaucuaccacaaaugugacaaugccugcauuggcagcaucagaaacggaaccuacgaccacgauguguaucgcgacgaggcucugaauaaccgguuccaaauuaagggcguugaacuuaagucuggguacaaagauuggauccuguggauuuccuuugccaucagcugcuuccuccugugugugguccugcucggauuuaucaugugggccugccagaagggcaauauuagauguaacaucugcauuuga

SEQ ID NO: 183762 - RNA, 1701 nt, Artificial Sequence
  derived and/or modified sequence opt5 from hemagglutinin__InfluenzaA__ABD60812
augaagaccaucauugcccugagcuacauccucugccugauuuucgcucagaaacuucccggcaacgacaauuccacagccacgcugugucucgggcaccaugcggugccuaacggaaccaucgucaagacaauuaccaaugaucaaaucgagguuacaaacgcuaccgaacuggugcagucuagcuccacaggcgggaucugcgacucuccgcaccagauucuugauggagagaauuguacccugaucgacgcccuccugggcgauccccagugcgacggguuucaaaacaaaaagugggaucuguucguggaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucuuucucuaugcgcaggccucuggccgcauuacaguguccaccaagagaagccaacagacaguuaucccguccauugggucucggccccgcgugagaaacaucccuagccggaucuccauuuacuggaccaucgucaaacccggagauauucugcugaucaauagcaccggcaaccucauugcuccucgcggguacuucaagaucagaucuggaaaguccagcaucaugcggucugacgcccccauuggcaaauguaauagcgagugcaucacaccgaacggcuccauuccuaaugacaagcccuuucagaacgugaaucgcaucacguauggggcuuguccuagauacgugaaacagaacacccugaagcuggccacaggaaugcggaauguccccgaaaaacaaacccgcggcauuuucggggcgaucgccggauuuaucgagaacggcugggaagggaugguugauggaugguauggcuucagacaccaaaauucugagggcauugggcaggcugccgaccuuaagagcacacaggcugccaucaaccagauuaauggaaaacucaaccggcugaucggcaagaccaacgagaaguuccaccagauugaaaaagaguuuuccgaaguggaggggagaauccaggaucuugaaaaguacguggaggacacgaaaauugaucuguggagcuauaaugccgagcuccuggucgcucuggaaaaccaacauacaaucgaccucaccgauucugagaugaauaagcuguucgaacgcaccaaaaagcagcuucgggagaacgcggaagacaugggaaauggcugcuuuaagaucuaccacaaaugugauaacgccugcauuggguccaucagaaauggcacauaugaccaugauguguaccgcgacgaggcucugaacaaucgguuccagauuaagggaguugagcucaaaagcggcuacaaggacuggauccuguggauuucuuuugccaucuccugcuuccuucuguguguggcccuccugggguuuaucaugugggcuugccagaaaggaaacauuagauguaauaucugcauuuga

SEQ ID NO: 183763 - RNA, 1701 nt, Artificial Sequence; identical to SEQ ID NO: 183657
  derived and/or modified sequence opt5 from hemagglutinin__InfluenzaA__ABD60823

SEQ ID NO: 183764 - RNA, 1701 nt, Artificial Sequence
  derived and/or modified sequence opt5 from hemagglutinin__InfluenzaA__ABD60845
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgaccagaauggaaccuccagcgcuugcaagagacggucuacaaaauccuuuuucagccgccucaacuggcugcaucaacuuaaguauaaguacccugcccugaaugugaccaugcccaacaaugagaaauuugauaagcucuauauuuggggcguucaccacccuucuacggacuccgaucagaucagccuguacgcgcaggccuccggcagagugacagucucuaccaaacggagccagcaaacagugaccccgaacauugggucccgccccugggugagaggagucagcucucggaucuccauuuacuggaccaucguuaagccuggcgacauucugcucaucaacagcacagggaaucugaucgcuccccgcggauauuucaaaauuagaucuggcaagagcuccaucaugcggucuaacgcccuuauugggaaguguaauagcgaaugcaucacgccuaacggauccauucccaaugacaaaccguuucagaacgugaaucgcaucaccuacggcgcuuguccuagauaugugaagcagaacacacugaaacucgccaccggcaugcggaauguccccgagaagcagacacgcgggaucuucggagcgauugccggcuuuaucgaaaacgggugggagggaaugguggauggcugguacggguucagacaucaaaauagcgagggaaccggccaggcugccgaccugaaaucuacgcaggcugccauuaaccaaaucaauggcaaacuuaaccggcugauugaaaagacaaaugagaaguuucaccagaucgaaaaggaguucuccgaaguugaggggagaauccaggaucucgagaaauauguggaagacaccaagauugaucuguggagcuacaacgccgagcugcucgucgcucuggaaaaccagcauaccaucgaccuuacagauucugagaugaauaaacuguucgaacgcacccggaagcaacucagagagaacgcggaggacaugggaaauggcugcuuuaaaauuuaucacaagugugauaacgccugcaucggguccauucgcaauggaacauacgaccacgauguguaccgggacgaagcucugaacaauagauuccagaucaagggcguugagcuuaaaagcggguauaaggacuggauucuguggaucuccuuugccaucucuugcuuccuccugugugugguccugcucggcuuuauuaugugggccugccagaaaggaaacauccgcuguaauauuugcaucuga

SEQ ID NO: 183765 - RNA, 1698 nt, Artificial Sequence
  derived and/or modified sequence opt5 from hemagglutinin__InfluenzaA__ABD60878
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagaaagcccuguaccacacagaaaacgcuuaugugagcgucguuuccucucauuacagcagacgguucacccccgagauugccaagcgcccuaaggugagagaccaggaagggcggaucaauuauuacuggacgcuucuggagcccggagauacaauuaucuuugaggcgaacggcaaucucauugccccucgcuaugcuuucgcccuguccagaggguuuggaagcggcaucauuaccucuaacgcucccauggacgaaugugaugccaaaugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggguggacaggaaugguggacggcugguauggcuaccaucaccagaacgagcaagggucuggauacgcugccgaucaaaagagcacgcagaaugccauuaacggcaucaccaauaaagucaacuccgugaucgaaaagaugaauacacaguuuaccgcuguugggaaagaguucaacaagcuggagcgcagaauggaaaaucucaacaagaaaguggacgauggauuccuggacauuuggacauauaacgcggagcuucugguccuccuggaaaaugagcggacccuugacuuucacgauagcaacgugaagaaucuguacgaaaaagucaagucucagcucaaaaacaaugccaaggagaucggcaacgggugcuucgaguuuuaucauaaguguaauaacgaaugcauggaguccgugaaaaauggcacguacgacuaucccaaguacagcgaagagucuaaacugaaccgcgagaagauugauggaguuaaacuggaauccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183766 - RNA, 1698 nt, Artificial Sequence
  derived and/or modified sequence opt5 from hemagglutinin__InfluenzaA__ABD60889
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacuccgugaucgaaaagaugaauacacaguuuaccgcuguugggaaagaguucaacaaacuggagagacggauggaaaaucucaacaagaagguggacgauggauuccuggacauuuggacauauaacgcggagcuucugguccuccuggaaaaugagcgcacccuugacuuucacgauagcaacgugaaaaaucuguacgaaaaggucaaaucucaacucaagaacaaugccaaagagaucggcaacgggugcuucgaguuuuaucauaaguguaauaacgaaugcauggaguccgugaagaauggcacguacgacuaucccaaauacagcgaagagucuaagcugaacagagagaaaauugauggaguuaagcuggaauccaugggcguguaucagauccucgcuauuuacagcacagucgccuccucucuggugcuucugguuagccucggggccaucuccuucuggaugugcucuaauggaagccugcagugucggaucugcauuuga

SEQ ID NO: 183767 - RNA, 1698 nt, Artificial Sequence
  derived and/or modified sequence opt5 from hemagglutinin__InfluenzaA__ABD60900
augaaggugaaaagacugguccuccugugcaccuucacagccacguacgcugacaccaucuguauuggcuaucacgccaacaauagcacagauaccguugacacagugcuugagaagaacgugaccgucacacauuccgugaaucugcucgaagauucucacaacgggaaacugugccuucugaagggaaucgcgccccuccagcugggcaauuguagcguugcuggguggauucugggaaacccugagugcgaacuccugaucuccaaagagucuuggagcuacauuguggaaaccccgaaucccgagaacggcacguguuauccuggguacuuugccgacuaugaggaacuucgggagcaacuguccucugucagcuccuucgaacgcuuugagaucuuccccaaggagagcucuuggccuaaucauaccgugacaggaguuuccgccagcugcucucacaacggcaaguccagcuuuuacagaaaucuccuguggcuuaccggcaaaaacgggcuguaucccaaucucucuaaguccuacgcuaacaauaaagaaaaggaggugcugguccuguggggagugcaucacccuccgaacaucggcgaucagaaagcccucuaccacacagaaaacgcuuaugugagcgucguuuccucucauuacagccggcgcuucacccccgagauugccaagagaccuaaggugcgggaccaggaagggcgcaucaauuauuacuggacgcugcuugagcccggagauacaauuaucuuugaggcgaacggcaaucugauugccccuagauaugcuuucgcccucucccggggguuuggaagcggcaucauuaccucuaacgcucccauggacgaaugugaugccaaaugccagacaccgcaaggcgcgaucaauuccagccugccuuuccagaacgugcaccccgucaccaucggggaguguccuaaguacgugcgcucugccaaacuuagaaugguuaccggacugcggaauauucccagcauccagucccgcggccucuuuggggcuauugccggauucaucgaaggcggguggacaggaaugguggacggcugguauggcuaccaucaccagaacgagcaagggucuggauacgcugccgaucaaaagagcacgcagaaugccauuaacggcaucaccaauaaagucaacuccgugaucgaaaagaugaauacacaguuuaccgcuguugggaaagaguucaacaagcuggagagacggauggaaaaucugaacaagaaaguggacgauggauuccucgacauuuggacauauaacgcggagcugcuuguccugcucgaaaaugagcgcacccuggacuuucacgauagcaacgugaagaaucuuuacgaaaaagucaagucucagcugaaaaacaaugccaaggagaucggcaacgggugcuucgaguuuuaucauaaguguaauaacgaaugcauggaguccgugaaaaauggcacguacgacuaucccaaguacagcgaagagucuaaacucaacagagagaagauugauggaguuaaacuggaauccaugggcguguaucagauccuggcuauuuacagcacagucgccuccucucucgugcugcuuguuagccugggggccaucuccuucuggaugugcucuaauggaagccuccagugucggaucugcauuuga

SEQ ID NO: 183768 - RNA, 1698 nt, Artificial Sequence
  derived and/or modified sequence opt5 from hemagglutinin__InfluenzaA__ABD60911
augaaggccaaacugauggugcuccugugcaccuucacagcuacguacgccgacaccaucuguauuggcuaucacgcgaacaauagcacagauaccgucgacacaguucuugagaagaacgugaccgugacacauuccgucaaucugcucgaagauucucacaacgggaaacugugccuucugaagggaaucgcuccccuccagcugggcaauuguagcguggccggguggauucugggaaacccugagugcgaacuccugaucuccaaagagucuuggagcuacauuguugaaaccccgaaucccgagaacggcacguguuauccuggguacuuugccgacuaugaggaacuuagagagcaacuguccucugugagcuccuucgaacgguuugagaucuuccccaaggagagcucuuggccuaaucauaccgucacaggaguguccgcuagcugcucucacaacggcaaguccagcuuuuaccgcaaucuccuguggcuuaccggcaaaaacgggcuguaucccaaucucucuaaguccuacgccaacaauaaagaaaaggagguucuggugcuguggggaguccaucacccuccgaacaucggcgaucagagagcucucuaccacacagaaaacgccuaugugagcguggucuccucucauuacagccggcgcuucacccccgagauugcgaaaagaccuaagguucgggaccaggaagggcgcaucaauuauuacuggacgcugcuugagcccggagauacaauuaucuuugaggccaacggcaaucugauugcuccuugguaugccuucgcucucuccagaggguuuggaagcggcaucauuaccucuaacgcccccaugggcgaaugugacgcgaagugccagacaccgcaaggggccaucaauuccagccugccuuuccagaacgugcaccccgugaccaucggagaguguccuaaauacguccggucugcuaaacuucgcauggugaccggccugagaaauauucccagcauccagucccgggggcucuuuggagccauugcuggcuucaucgaagggggauggacaggcaugguugauggcugguauggguaccaucaccagaacgagcaaggaucuggcuacgccgccgaccagaaaagcacgcagaaugcuauugaugggaucaccaacaaggucaauuccaucauugaaaagaugaacacacaguuuaccgcggugggaaaggaguucaauaaacuggagcgcagaauggaaaaccugaauaagaagguggacgauggcuuccucgacaucuggacauauaacgccgagcugcuuguucugcucgaaaacgagcggacccuggacuuucacgauagcaaugugaaaaaccuuuacgaaaaggucaaaucucaacugaagaauaacgcuaaagagauugggaauggcugcuucgaguuuuaucauaaguguaacaaugaaugcauggaguccgugaagaacggaacguacgacuaucccaaauacagcgaagagucuaagcucaaucgcgagaaaaucgauggcgucaagcuggaauccauggggguguaucagauucuggccaucuacagcacaguugccuccucucucgugcugcuugucagccugggagcuaucuccuucuggaugugcucuaacggcagccuccaguguagaauuugcaucuga

SEQ ID NO: 183769 - RNA, 1701 nt, Artificial Sequence; identical to SEQ ID NO: 183056
  derived and/or modified sequence opt5 from hemagglutinin__InfluenzaA__ABD60922

SEQ ID NO: 183770 - RNA, 1701 nt, Artificial Sequence
  derived and/or modified sequence opt5 from hemagglutinin__InfluenzaA__ABD60933
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuggugagcaagaaguccuggucuuauauugccgagaccccgaacagcgaaaauggcacauguuaccccggguauuucgccgauuacgaggagcuucgggaacaacuguccagcguuucuuccuuugagcgcuucgaaaucuuuccuaaagagagaagcuggcccaagcauaacgugacccggggagucacggcuucuugcucccacaaaggcaagagcucuuucuaucgcaaucuccuguggcuuaccgagaaaaacggcuccuacccuaaucugagcaaguccuaugugaacaauaaggaaaaagagguucucgugcuguggggaguccaucaccccucuaacaucgaagaccagaagacaauuuacagaaaagagaaugccuacgugagcguggucuccagcaacuauaaccggcgcuuuaccccugaaaucgcggagagaccgaagguucgggggcaggccggccgcauuaauuacuauuggacacugcucgagcccggggauaccaucauuuucgaagcuaacggaaaucugaucgccccuuggcacgcuuuugcccuuaacagaggcuucgggucuggaauuaucacguccaaugcgagcauggacgagugugauacaaaaugccagacaccccaaggcgccaucaacucuagccugccuuuucagaauauucaucccgugaccaucggcgaauguccgaaguacgugcgguccaccaaacuccgcauggucaccgggcugagaaacauuccuucuauccagagccggggacuuuucggcgcuauugccggguuuaucgagggaggcuggacagggaugaucgacggaugguauggcuaccaccaucagaaugaacaaggcuccggguaugcugccgaucagaagucuacgcagaacgccauuaauggaaucaccaacaaggugaauagcguuauugagaaaaugaacacacaguucaccgcugugggcaaggaguuuaauaaacuggaaaagcgcauggagaaccucaacaaaaaggucgacgauggguuccuggacaucuggacauacaaugcggaacugcucgugcugcuugagaacgaaagaacccuggacuuccacgauuccaauguuaagaaccucuacgagaaagucaagagccaacugaaaaauaacgccaaggagauuggaaauggcugcuuugaguucuaucacaaauguaacaaugaaugcauggaaucugugaagaacgggacguacgacuaucccaaguacuccgaggagagcaaacuuaaucgggaaaagaucgauggcgugaaacuggaguccaugggagucuaucagauccucgcuauuuacucuacaguggccagcucccugguucugcucgugucucugggcgccaucagcuuuuggaugugcuccaacgggagccuucaguguagaauuugcaucuga

SEQ ID NO: 183771 - RNA, 1701 nt, Artificial Sequence
  derived and/or modified sequence opt5 from hemagglutinin__InfluenzaA__ABD60944
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucgcggagagaccgaagguccgggggcaggccggccgcauuaauuacuauuggacacugcucgagcccggggauaccaucauuuuugaagcuaacggaaaucugaucgccccuugguacgcuuucgcccuuucuagaggcuuuggguccggaauuaucacgagcaacgcgucuauggacgagugugauacaaaaugccagacaccccaaggcgccaucaauagcucccugccuuuccagaacguucaccccgugaccauuggcgaauguccgaaguaugugcggucuaccaaacuccgcauggucaccgggcugagaaauaucccuagcauucagucccggggacuuuuuggcgcuaucgccggguucauugagggaggcuggacagggaugaucgacggaugguacggcuaucaucaccagaacgaacaaggcagcggguacgcugccgaucagaagucuacgcagaaugccaucaacggaauuaccaauaaggugaacuccguuaucgagaaaaugaauacacaguuuaccgcugugggcaaggaguucaacaaacuggaaaagcgcauggagaaucucaacaaaaaggucgacgauggguuccuggacauuuggacauacaacgcggaacugcucgugcugcuugagaaugaaagaacccuggacuuucaugauagcaacguuaagaaucucuaugagaaagugaagucucaacugaaaaacaaugccaaggagaucggaaacggcugcuucgaauuuuaccacaaauguaauaacgagugcauggaauccgucaagaaugggacguaugacuaccccaaguauagcgaggaguccaaacuuaaccgggaaaagauugauggcgugaaacuggagucuaugggagucuaccagauccucgcuaucuauagcacaguggccuccucucugguucugcucgugagccugggcgccauuuccuucuggaugugcagcaaugggucucuucaguguagaaucugcauuuga

SEQ ID NO: 183772 - RNA, 1701 nt, Artificial Sequence
  derived and/or modified sequence opt5 from hemagglutinin__InfluenzaA__ABD60955
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccuaaaugcgagucccucuuuucuaaggaaagcugguccuacaucgccgagacaccgaaucccgaaaacggcaccuguuauccuggguacuucgccgacuaugaggagcugcgggaacaacuuucuagcguuuccagcuuugagcgcuucgaaauuuuucccaaggagucuuccuggccuaaucauacggugaccaaaggagucacaaccagcugcucucacaacggcaaguccagcuucuacagaaaucugcucuggcugacagagaaaaacggccuuuaucccaaucugucuaaguccuacgugaacaauaaagaaaaggagguucucgugcuguggggaguccaucacccuagcaacauccgggaucagcgcgcuaucuaccacaccgaaaacgccuauguguccguggucucuagccauuacuccagacgguuuacgccggagauugcgaagcgccccaaaguuagagaccaggaagggcggaucaauuauuacuggacacugcucgagccuggcgauaccauuaucuucgaggccaacgggaaucugauugcucccugguaugccuuugcucuuagccgcggauucggcucugggaucauuacauccaacgccagcauggacgaaugugaugcgaagugccagaccccucaaggagccaucaauucuagccugcccuuucagaacgugcacccggugaccaucggcgaguguccuaaauacgucagauccacaaagcuccggauggugacgggccugcgcaauauucccucuauccagagcagagggcuuuucggagcuauugccggcuuuaucgaagggggauggaccggcaugauugacgggugguauggauaccaucaccagaacgagcaaggcuccggcuacgcugccgaucagaaaagcacacagaaugccaucaacgggaucaccaauaagguuaacucugugauugaaaagaugaauacacaguucaccgcugucggaaaggaguucaacaagcuggagcggcgcauggaaaaucucaacaaaaagguggacgauggcuuucuggacaucuggacguauaacgcggagcugcucguucugcuugaaaaugggagaacacuggacuuccacgauuccaacgugaaaaaucucuacgagaaggucaaaagccaacugaagaacaaugccaaggaaauuggaaacggcugcuuugaguucuaucauaaauguaauaacgagugcauggaaucugugaagaaugggaccuacgacuauccuaaauacuccgaggaaagcaaacuuaaccggggcaaaaucgauggagucaagcuggaguccaugggcguguaucagauucucgcuaucuacucuaccguugccagcucccuggugcugcucgucucucugggggccaucagcuuuuggaugugcuccaauggaagccuucaguguagaauuugcaucuga

SEQ ID NO: 183773 - RNA, 1701 nt, Artificial Sequence; identical to SEQ ID NO: 183056
  derived and/or modified sequence opt5 from hemagglutinin__InfluenzaA__ABD61260

SEQ ID NO: 183774 - RNA, 1701 nt, Artificial Sequence; identical to SEQ ID NO: 183056
  derived and/or modified sequence opt5 from hemagglutinin__InfluenzaA__ABD61271

SEQ ID NO: 183775 - RNA, 1701 nt, Artificial Sequence; identical to SEQ ID NO: 183310
  derived and/or modified sequence opt5 from hemagglutinin__InfluenzaA__ABD61282

SEQ ID NO: 183776 - RNA, 1701 nt, Artificial Sequence; identical to SEQ ID NO: 183540
  derived and/or modified sequence opt5 from hemagglutinin__InfluenzaA__ABD61293

SEQ ID NO: 183777 - RNA, 1701 nt, Artificial Sequence; identical to SEQ ID NO: 183762
  derived and/or modified sequence opt5 from hemagglutinin__InfluenzaA__ABD61304

SEQ ID NO: 183778 - RNA, 1701 nt, Artificial Sequence; identical to SEQ ID NO: 183674
  derived and/or modified sequence opt5 from hemagglutinin__InfluenzaA__ABD61315

SEQ ID NO: 183779 - RNA, 1701 nt, Artificial Sequence; identical to SEQ ID NO: 183096
  derived and/or modified sequence opt5 from hemagglutinin__InfluenzaA__ABD61337

SEQ ID NO: 183780 - RNA, 1701 nt, Artificial Sequence
  derived and/or modified sequence opt5 from hemagglutinin__InfluenzaA__ABD61348
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaauaacaaaccuuuucagaaugugaaccgcauuacauacggcgccugucccagauaugugaagcagaauacgcuuaaacuggcgaccggcaugcggaacgucccugagaagcagacacgcgggaucuucggagccauugcuggcuuuaucgaaaaugggugggagggaaugguggacggcugguacggguucagacaucaaaacagcgagggaaccggccaggccgcugaccucaaaucuacacaggccgccauuaaucaaaucaacggcaagcugaaucggcuuaucgagaaaaccaacgaaaaguuucaccagauugaaaaggaguucuccgaaguugaggggagaauccaggaucuggagaaauauguggaagacacgaagauugaucucuggagcuacaacgcugagcugcuggucgcgcucgaaaaucagcauacaaucgaccugaccgauucugagaugaacaaacuuuucgaacgcacccggaagcaacugagagagaaugccgaggacaugggaaacggcugcuuuaaaauuuaucacaagugugauaaugcuugcaucggguccauucgcaacggaacauacgaccacgauguguaccgggacgaagcccucaauaacagauuccagaucaagggcguugagcugaaaagcggguauaaggauuggauccuuuggauuuccuuugccaucucuugcuuccugcucugugugguccugcugggcuuuauuaugugggcuugccagaaaggaaauauccgcuguaacauuugcaucuga

SEQ ID NO: 183781 - RNA, 1701 nt, Artificial Sequence; identical to SEQ ID NO: 183096
  derived and/or modified sequence opt5 from hemagglutinin__InfluenzaA__ABD61359

SEQ ID NO: 183782 - RNA, 1701 nt, Artificial Sequence; identical to SEQ ID NO: 183734
  derived and/or modified sequence opt5 from hemagglutinin__InfluenzaA__ABD61370

SEQ ID NO: 183783 - RNA, 1701 nt, Artificial Sequence; identical to SEQ ID NO: 183674
  derived and/or modified sequence opt5 from hemagglutinin__InfluenzaA__ABD61381

SEQ ID NO: 183784 - RNA, 1701 nt, Artificial Sequence
  derived and/or modified sequence opt5 from hemagglutinin__InfluenzaA__ABD61392
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcgggucuaacaaguccuuuuucagcagacucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccgggccggguuaccguguccacgaagcgcucucaacagacagucauucccaacaucgggagcagaccuugggugcggggaguguccagccgcauuucuaucuacuggaccauugucaaacccggcgauauccugcucaucaauuguacagggaaccugauugccccuagaggauauuucaagauccgguccggcaagagcucuauuaugcgcagcgacgcuuccaucggcaaaugcaauucugaauguauuacccccaacgggagcaucccgaaugacaagccuuuucagaacguuaauagaaucaccuacggagccugcccccgguaugugaaacagaacacacuuaagcuggcgacgggcaugcgcaaugugccugagaaacaaaccagagggauuuucggagccaucgcuggcuuuauugaaaacgggugggagggaauggucgauggcugguacggcuuccggcaccaaaauuccgaggggacaggacaggccgcugaccucaagagcacccaggccgccaucaaccagauuaauggcaaacugaaccgccuuaucgaaaagacaaaugagaaguuucaucagaucgaaaaagaguucucugaaguggaggggcggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugagagagaacgccgaggacaugggaaauggcuguuuuaagaucuaucauaaaugcgauaacgcuugcauugggucuauccgcaauggcaccuacgaccacgaugucuaccgggacgaagcccucaacaauagauuccagauuaagggaguggagcugaaauccggcuauaaggacuggauccuuuggaucagcuuugccauuuccuguuuccugcucugcguugugcugcugggguuuaucaugugggcuugucagaaaggaaacauucgcugcaauaucuguauuuga

SEQ ID NO: 183785 - RNA, 1701 nt, Artificial Sequence; identical to SEQ ID NO: 183764
  derived and/or modified sequence opt5 from hemagglutinin__InfluenzaA__ABD61403

SEQ ID NO: 183786 - RNA, 1701 nt, Artificial Sequence
  derived and/or modified sequence opt5 from hemagglutinin__InfluenzaA__ABD61529
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuucuccaauuguuauccuuacgacgugcccgauuaugcuucucucagaagccugguugccuccagcgggacgcuugaguuuauuaacgaaggauucaauuggaccggcgugacacagucuggcggguccuacgcuugcaagcggggaagcgucaacagcuuuuucucccgccugaauuggcucuaugagagcgagucuaaguacccugugcugaacguuaccaugcccaauaacggcaaauuugacaagcuguauaucuggggagugcaccauccuuccacagauaaagaacaaaccaaucuguacgucagagccagcgggcgggugacgguguccacaaagcgcucucagcagaccgucauuccgaacaucggcagcagacccuggguucgggggcucuccagccgcauuucuaucuacuggacaauugugaaaccuggagacauccugcugaucaacuccaccggcaaucucauugcgcccagaggcuauuucaagauccggaccgggaagucuucuauuaugcgcagcgaugccccuaucggaacauguuccucugagugcauuacgcccaacggcagcaucccgaaugacaaaccuuuucagaacgugaauaagaucaccuacggggcuugucccagauaugucaaacaaaacacacugaaacuugccaccggaaugcggaaugugccugaaaagcagacacgcggcauuuucggggcuaucgccggauuuauugagaacggcugggagggcaugguugacgggugguacggauucagacaccaaaauuccgaaggcaccgggcaggcggccgaucuuaagagcacgcaggcugccaucgaccagauuaacggacggcucaauagacugaucgagaaaacaaacgaaaaguuccaccagaucgagaaggaauuuucugagguggagggccgcauucaagaucuugaaaaauaugucgaggacaccaagaucgaucugugguccuacaaugcugaacuccugguggcccuggagaaccagcauaccauugaccucacagauagcgaaaugaauaaacuguucgagaagacccggaaacagcuuagagagaacgccgaagacauggggaacggcugcuuuaagaucuaucacaagugugauaaugcuugcauuggaucuauccgcaacggcacauacgaccaugauguuuaccgggacgaggcgcugaauaacagauuccagauuaaagggguggaacucaaguccggauauaaagacuggauccuguggaucagcuuugccauuuccugcuuccuucugugugucgugcuccugggcuuuaucaugugggcuugccaaaaggggaauauucgcuguaacaucugcauuuga

SEQ ID NO: 183787 - RNA, 1698 nt, Artificial Sequence; identical to SEQ ID NO: 183765
  derived and/or modified sequence opt5 from hemagglutinin__InfluenzaA__ABD61540

SEQ ID NO: 183788 - RNA, 1701 nt, Artificial Sequence
  derived and/or modified sequence opt5 from hemagglutinin__InfluenzaA__ABD61757
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacgugacaaugccuaauaacgacaacuccgauaagcuguacauuuggggaguucaccauccgagcaccgacaaagagcagacggaccuuuaugugcaggccucuggcaaggucacaguguccaccaaacgcagccagcaaacagugauccccaaugucggguccagaccuuggguucggggacugucuagccgcguguccauuuacuggaccaucgugaagcccggcgauauucucgucaucaacagcaauggcaaccugaucgcgccuagaggguacuuuaaaaugcggaccggaaagucuuccauuaugcgcagcgacgcccccaucggcacauguucuagcgagugcauuacgccgaauggguccaucccuaacgauaagcccuuccagaaugugaacaaaauuaccuauggagcuuguccuaaguacguuaaacagaauacacugaagcucgccaccggcaugagaaacgugcccgaaaaacagacacgggggaucuuuggagcuaucgccggcuucauugagaauggcugggaagggaugaucgacggaugguauggcuuucgccaccaaaacucugaggggaccggacaggcggccgaucuuaagagcacgcaggcugccauugaccaaaucaauggcaaacugaacagagucauugagaagacaaaugaaaaguuccaccagaucgagaaagaguucuccgaaguggaagggcggauccaggaucuggagaaguacguugaggacaccaaaauugaucucuggagcuauaacgcugaacugcuuguggcccuggagaaccagcauaccaucgaccucacagauucugaaaugaauaagcuguuugagaaaacccgcagacaacugcgggaaaacgccgaggacaugggcaauggaugcuucaagauuuaccacaagugugacaacgcuugcaucggcuccauuagaaaugggacauaugaucaugacgucuaccgcgaugaggcgcucaacaaucgguuucagaucaaaggaguggaacuuaagagcggcuacaaagacuggauucuguggaucucuuucgccaucuccugcuuucugcucugugucgugcugcuuggguucauuaugugggcuugccagaagggaaacaucagauguaauauuugcaucuga

SEQ ID NO: 183789 - RNA, 1701 nt, Artificial Sequence
  derived and/or modified sequence opt5 from hemagglutinin__InfluenzaA__ABD61777
augaagaccaucauugcccugagcuacaucuucugccucggcuuugcucagaaacugcccgggaacgacaauuccacagccacgcuuugucugggacaccaugcggugccuaacggcacccucgucaagacaauuaccaaugaucaaaucgagguuacaaacgcuaccgaacuggugcagucuagcuccacagggagaauuugcgacucuccgcaccggauccuugauggaaagaauuguacccugaucgacgcccuccugggcgauccccauugcgacggguuccagaacgagaagugggaucuguuuguggaacgcagcaaagccuucuccaauuguuauccuuacgacguccccgauuaugcuucucucagaagccugguggccuccagcggaacgcuugaguuuauuaacgaaggcuucaauuggaccggcguuacacagucugggggauccuacgcuugcaagcggggcagcgugaacuccuuuuucucucgccugaauuggcucuaugagagcgagucuaaguacccugcccugaacgucaccaugcccaauaacgggaaauuugacaagcuguauaucuggggagugcaccauccuuccacagauaaagaacaaaccaaucuguacguuagagcgagcggccgggugacggucuccacaaagcgcucucagcagaccgugauuccgaacaucgggagcagacccugggugcggggacucuccagccgcauuucuaucuacuggacaauugucaaaccuggcgacauccugcugaucaacuccaccggcaaucucauugcccccagaggguauuucaagauccggaccggaaagagcucuauuaugcgcagcgaugcuccuaucggcacauguuccucugagugcauuacgcccaacgggagcaucccgaaugacaaaccuuuucagaacguuaauaagaucaccuacggagccugucccagauaugugaaacaaaacacacugaaacuugcuaccggcaugcggaaugugccugaaaaacagacacgcgggauuuucggagccaucgcgggcuuuauugagaacggcugggaggggauggucgacggaugguacggcuucagacaccaaaauuccgaagggaccggacaggccgcugaucuuaagagcacgcaggccgcuaucgaccagauuaacggcaaacucaaucggcugaucgagaagacaaacgaaaaguuccaccagaucgagaaagaauuuucugagguggaggggcgcauucaagaucuugaaaaguauguugaggacaccaaaaucgaucugugguccuacaaugccgaacuccugguggcccuggagaaccagcauaccauugaccucacagauagcgaaaugaauaagcuguucgagaaaaccagaaagcagcuucgggagaacgcugaagacaugggcaacggaugcuuuaagaucuaucacaaaugugauaaugcgugcauuggcucuaucagaaacgggacauacgaccaugaugucuaccgcgacgaggcccugaauaaccgguuccagauuaagggaguggaacucaaauccggcuauaaggacuggauccuguggaucagcuuugcuauuuccugcuuccuucuguguguugugcuccugggguuuaucaugugggccugccaaaaaggaaauauuagauguaacaucugcauuuga

SEQ ID NO: 183790 - RNA, 1701 nt, Artificial Sequence
  derived and/or modified sequence opt5 from hemagglutinin__InfluenzaA__ABD77598
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcccgacaggaagaauuugcgacucuccccaucagauccuggauggcgagaauuguacccucaucgacgcccugcugggggauccucacugcgacggauuucagaacaaagaaugggaucucuucguggagcggucuacggccuauagcaauuguuaccccuaugacguuccugauuacgcuucccugcgcucucuuguggccagcuccggcacccuggaauuuaacaaugagagcuucaacuggacaggggucgcucagaauggaaccucuuccgccugcaagagacggagcauuaaauccuuuuucucccgccucaacuggcugcaucaacuuaaguauaaguaccccgcgcugaaugugacaaugccuaacaaugagaaauuugacaagcucuauaucuggggcguucaccacccgagcaccgauucugaccagauuucccuguacgcccaggcuagcggcagagugacggucuccacaaaacggucucagcaaaccgugauccccaacauugggagccgcccuugggugagaggagucuccagccggaucucuauuuacuggacaaucguuaagcccggcgauauccugcucauuaacuccaccgggaaucugaucgccccucgcggauauuucaaaauuagaagcggcaagucuagcaucaugcgguccaacgcucccauugggaaguguaauucugaaugcaucaccccgaacggaagcaucccuaaugacaaacccuuucagaacgugaaucgcauuacauacggcgccuguccuagauaugugaagcagaacacgcuuaaacuggcgaccggcaugcggaauguccccgagaagcagacacgcgggaucuucggagccauugcuggcuuuaucgaaaacgggugggagggaaugguggacggcugguacggguucagacaucaaaauuccgagggaaccggccaggccgcugaucucaaaagcacacaggccgccauuaaccaaaucaauggcaagcugaaccggcuuaucgagaaaaccaaugaaaaguuucaccagauugaaaaggaguucucugaaguugaggggagaauccaggaccuggagaaauauguggaagauacgaagauugaccucugguccuacaacgcugagcugcuggucgcgcucgaaaaccagcauacaaucgaucugaccgacagcgagaugaauaaacuuuucgaacgcacccggaagcaacugagagagaacgccgaggauaugggaaauggcugcuuuaaaauuuaucacaagugugacaacgcuugcaucgggucuauucgcaauggaacauacgaucacgacguguaccgggaugaagcccucaacaauagauuccagaucaagggcguugagcugaaauccggguauaaggacuggauccuuuggauuagcuuugccaucuccugcuuccugcucugugugguccugcugggcuuuauuaugugggcuugccagaaaggaaacauccgcuguaauauuugcaucuga

SEQ ID NO: 183791 - RNA, 1701 nt, Artificial Sequence; identical to SEQ ID NO: 183674
  derived and/or modified sequence opt5 from hemagglutinin__InfluenzaA__ABD77609

SEQ ID NO: 183792 - RNA, 1701 nt, Artificial Sequence; identical to SEQ ID NO: 183674
  derived and/or modified sequence opt5 from hemagglutinin__InfluenzaA__ABD77620

SEQ ID NO: 183793 - RNA, 1701 nt, Artificial Sequence; identical to SEQ ID NO: 183674
  derived and/or modified sequence opt5 from hemagglutinin__InfluenzaA__ABD77631

SEQ ID NO: 183794 - RNA, 1701 nt, Artificial Sequence; identical to SEQ ID NO: 183674
  derived and/or modified sequence opt5 from hemagglutinin__InfluenzaA__ABD77642

SEQ ID NO: 183795 - RNA, 1701 nt, Artificial Sequence; identical to SEQ ID NO: 183674
  derived and/or modified sequence opt5 from hemagglutinin__InfluenzaA__ABD77653

SEQ ID NO: 183796 - RNA, 1698 nt, Artificial Sequence; identical to SEQ ID NO: 183765
  derived and/or modified sequence opt5 from hemagglutinin__InfluenzaA__ABD77708

SEQ ID NO: 183797 - RNA, 1698 nt, Artificial Sequence
  derived and/or modified sequence opt5 from hemagglutinin__InfluenzaA__ABD77719
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcggaaucaggaagggcgcaucaacuauuacuggacgcuucuggagcccggagacacaauuaucuuugaggcgaauggcaaccucauugccccuagauaugcuuucgcccugucccggggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcgcucugccaagcugagaaugguuaccggacuccggaacauucccagcauccagucccgcggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagagacggauggaaaaccucaacaagaagguggaugacggauuccuggauauuuggacauauaaugcggagcuucugguccuccuggaaaacgagcgcacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaauagagagaaaauugacggaguuaagcuggaauccaugggcguguaucagauccucgcuauuuacagcacagucgccuccucucuggugcuucugguuagccucggggccaucuccuucuggaugugcucuaacggaagccugcagugucggaucugcauuuga

SEQ ID NO: 183798 - RNA, 1698 nt, Artificial Sequence; identical to SEQ ID NO: 183765
  derived and/or modified sequence opt5 from hemagglutinin__InfluenzaA__ABD77730

SEQ ID NO: 183799 - RNA, 1701 nt, Artificial Sequence; identical to SEQ ID NO: 183674
  derived and/or modified sequence opt5 from hemagglutinin__InfluenzaA__ABD77752

SEQ ID NO: 183800 - RNA, 1701 nt, Artificial Sequence; identical to SEQ ID NO: 183674
  derived and/or modified sequence opt5 from hemagglutinin__InfluenzaA__ABD77763

SEQ ID NO: 183801 - RNA, 1701 nt, Artificial Sequence
  derived and/or modified sequence opt5 from hemagglutinin__InfluenzaA__ABD77774
augaagaccaucauugcccugagcuacauccucugccugguguucgcucagaaacuucccgucaacgacaauuccacagccacgcugugucucggccaccaugcgguuccuaacgggacccuggugaagacaauuaccaaugauaacaucgaggugacaaaugcuaccgaacuuguccaaucuagcuccacaggaagaauuugcgacucuccgcaccagauccuggauggcgagaacuguacccucaucgacgcccugcugggggauccccauugcgacggauuucagaauaaagaaugggaucucuucguggagcggagcacggccuauuccaacuguuacccuuaugacguucccgauuacgcuucucugcgcagccuuguggccuccagcggcacccuggaauuuaauaacgagucuuucaauuggacaggggucgaccagaacggaaccuccagcgcuugcaagagacggucuaauaaauccuuuuucagccgccucaacuggcugcaccaacuuaaguauaaguacccugcccugaaugugacaaugcccaacaacgagaaauuugauaagcucuauauuuggggcguucaucacccuucuaccgacuccgaucagaucagccuguacgcgcaggccuccggcagagugacggucucuacaaaacggagccagcaaaccgugauuccgaauaucgggucccgccccugggugagaggagucagcucucggauuuccaucuacuggacaauuguuaagccuggcgacauccugcucaucaacagcaccgggaaucugauugcuccccgcggauauuucaaaaucagaucuggcaagagcuccauuaugcggucuaacgccccuaucgggaaguguaauagcgaaugcauuacccagaacggauccauccccaaugacaaaccguuucagaacgugaaucgcaucacauacggcgcuuguccuagauaugugaagcagaacacgcuuaaacuggccaccggcaugcggaauguccccgagaagcaaacacgcgggauuuucggagcgaucgccggcuuuauugaaaacgggugggagggaaugguggauggcugguacggguucagacaccagaauagcgagggaaccggccaggcugccgaccucaaaucuacacaagcugccaucaaccagauuaauggcaagcugaaccggcuuaucgagaaaaccaacgaaaaguuucaucagaucgaaaaggaguucuccgaaguugaggggcgcauucaggaucuggagaaauauguggaagacacgaagaucgaucucuggagcuacaaugccgagcugcuggucgcucucgaaaaccaacacacaauugaccugaccgauucugagaugaauaaacuuuucgaaagaacccggaagcagcugagagagaacgcggaggacaugggaaauggcugcuuuaaaaucuaucauaagugugauaacgccugcauuggguccauccgcaauggaacauacgaccacgauguguaccgggacgaagcucucaacaauagauuccagauuaagggcguugagcugaaaagcggguauaaggacuggauccuuuggaucuccuuugccauuucuugcuuccugcucugugugguccugcugggcuuuaucaugugggccugccagaaaggaaacauucgcuguaauaucugcauuuga

SEQ ID NO: 183802 - RNA, 1701 nt, Artificial Sequence; identical to SEQ ID NO: 183801
  derived and/or modified sequence opt5 from hemagglutinin__InfluenzaA__ABD77785

SEQ ID NO: 183803 - RNA, 1701 nt, Artificial Sequence
  derived and/or modified sequence opt5 from hemagglutinin__InfluenzaA__ABD77807
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaauugccccgcugcagcugggcaaauguaauaucgccggguggauucucggaaacccugagugcgaaucccugcuuucuaagcggagcugguccuauaucgcugagacccccaauucugaaaacggcacauguuaccccggggauuucgccgacuaugaggagcugcgcgaacaacucagcuccgucagcucuuuugagagauucgaaaucuuuccuaaggagcgguccuggcccaaacauaauauuacccgcggagugacggcugccugcagccacgcgggcaagucuuccuucuacaaaaaccugcuuuggcugaccgagacaaauggcagcuauccuaagcucucuaaauccuacguuaacaauaaggaaaaggaggugcugguccuguggggagugcaucaccccagcaacaucgaagaucagaaaacccucuauagaaaggagaaugccuacguuuccguggucucuagcaacuacaaccggcgcuuuacaccugaaauugcugagagaccgaaagugcgggggcaggccggccgcaugaauuauuacuggacccugcuugagcccggggacacgaucauuuucgaagcuaacggaaaucugaucgccccuugguaugcguuugcccucuccagaggcuucgggagcggaauuaucacaucuaacgcuuccauggaugagugugacaccaagugccagacaccccaaggcgccaucaauagcucucugccuuuucagaacauucaccccgugaccaucggcgaauguccgaaauacgucaagagcaccaaacuucggaugguuacagggcugcgcaauauuccuuccauccagucuagaggacucuucggcgcuauugccggguuuaucgagggaggcuggacggggaugaucgauggaugguauggcuaccaucaccagaacgaacaaggcagcggguaugccgcugaccagaaguccacccagaaugcgauuaacggaaucacaaauaaggugaacagcgugauugagaaaaugaauacccaguucacagccgucggcaaggaguuuaacaaacuggaaaagcggauggagaaucugaacaaaaagguggaugacggguuccucgacaucuggaccuacaacgcugaacugcuuguucugcucgagaaugaacgcacgcuggauuuccaugacucuaacgugaagaaucuuuacgagaaagucaagaaccaacugagaaauaacgccaaagagauuggaaauggcugcuuugaguucuaucacaaguguaacaaugaaugcauggaauccgugaaaaacgggacauacgauuaucccaaguacagcgaggagucuaagcucaaucgggagaaaaucgacggcguuaagcuggaauccaugggaguguaucagauccuggccauuuacagcaccgucgcuuccucucucgugcugcuugucagccugggcgccaucuccuuuuggaugugcucuaacgggagccuccaguguagaauuugcaucuga

SEQ ID NO: 183804 - RNA, 1701 nt, Artificial Sequence
  derived and/or modified sequence opt5 from hemagglutinin__InfluenzaA__ABD77818
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaccguuacgagaggagugaccgcuuccugcagccacaaaggcaagucuuccuuuuaucggaaccuccuguggcuuacagagaaaaauggcagcuacccuaaccuguccaagucuuaugucaauaacaaggaaaaagaggugcucguucuguggggagugcaucaccccagcaauaucgaagaccagaagaccauuuaccgcaaagagaacgccuacgucuccguggugagcucucacuauaauagacgguucacaccugaaaucgcgaagcgcccgaaagucagagaucaggaggggcggauuaacuacuauuggacccugcucgagcccggcgacacgaucauuuuugaagccaacgggaaucugaucgcuccuugguacgccuucgcucuuucccgcggauuuggcagcgggauuaucacaucuaacgccagcauggaugagugugacgcgaagugccagacaccccaaggagccaucaauuccucucugccuuuccagaacguucaucccgugaccauuggcgaauguccgaaauaugugagaagcaccaagcuccggauggucaccggccugcgcaauaucccuuccauucagagcagagggcuuuuuggagcuaucgccggcuucauugaagggggauggacaggcaugaucgaugggugguacggauaucaccaucagaacgaacaaggcucuggcuacgcugccgaccagaaguccacgcagaaugccaucaacgggauuaccaauaaagugaacagcguuaucgagaagaugaauacacaguuuaccgcugugggaaaagaguucaacaagcuggaaaaacggauggagaaucucaacaagaaggucgaugacggcuuccuggacauuuggacauacaaugcggaacugcucgugcugcuugagaacgaacgcacccuggauuuucacgacucuaacguuaaaaaucucuaugagaaggugaaaucccaacuuaagagcaacgccaaagagaucgggaauggaugcuucgaauuuuaccacaaguguaacaaugagugcauggaauccgucaagaacggcacguaugauuaccccaaauauucugaggagagcaagcugaauagagagaaaauugacggggugaagcuggaguccaugggcgucuaccagauccucgcuaucuauucuacaguggccagcucccugguucugcucgugagccugggagccauuucuuucuggaugugcuccaacggcagccuucagugucggaucugcauuuga

SEQ ID NO: 183805 - RNA, 1701 nt, Artificial Sequence
  derived and/or modified sequence opt5 from hemagglutinin__InfluenzaA__ABD77829
augaagaccaucauugcccugagcuacauccucuaucugguguucgcucagaaacuucccggcaacgacaauuccacagccacgcugugccucgggcaccaugcggucccuaacggaacccugguuaagacaauuaccaaugaucaaaucgaggugacaaacgcuaccgaacuugugcagucuagcuccacaggcagacugugugacucuccgcaccggauucucgaugggaaaaauugcacccugaucgacgcccugcucggagauccccauugugacggcuuucagaacaaggagugggaucuguucgucgaacgcagcaaagccuacuccgacugcuauccuuacgaugugcccgacuaugcuucucuuagaagccugguugccuccagcgggacgcucgaguuuaccaaugaaggauucaacuggacaggcguggcucagaauggcaccucuuacgccuguaagcggggguccgucaagagcuuuuucucucgccugaacuggcuucacaaacuggaguauaaguacccugcgcucaaugugacaaugcccaacaaugauaaauuugacaagcuguacaucuggggaguucaucacccuuccaccgauagcgaccaaacgucucuguaugugcaggccuccggcagagucacagugagcaccaaacggucccagcagacagugauuccgaacaucgggucucgccccugggucagaggaguuagcucccggauuagcaucuacuggaccauugugaagccuggcgacauccuccugauuaauucuaccgggaaccuuaucgcuccccgcggauauuucaagaucagauccggcaaaagcucuauuaugcggagcgaugccccuaucggcaacugcaauuccgaguguauuacacccaacgggucuaucccgaaugacaagccuuuucaaaacgugaaucgcauuacguacggagcuugccccagauaugucaaacagaacacccugaagcucgccacaggcaugcggaaugugccugaaaaacagacccgcgggaucuucggagcgaucgccggcuuuauugagaacgggugggaaggaaugguugauggcugguacggcuucagacaccagaauagcgaggggacaggacaagcugccgaccugaaguccacccaggcugccaucaaccagauuaauggcaaacuuaaccggcugaucgagaagacgaaugaaaaguuucaucaaauugagaaagaguucagcgaaguggaagggagaauccaggaucucgagaaguaugucgaggacacaaaaaucgaucuguggucuuacaacgccgaacugcucguggcucuggagaaucagcacaccauugaccuuaccgauuccgaaaugaacaagcuguucgagcgcacacggaaacagcucagagaaaacgcggaggacaugggaaauggcuguuuuaagaucuaccauaagugcgauaacgccuguauugggagcauccgcaauggcaccuaugaccacgacguuuaccgggaugaggcucugaacaauagauuccaaauuaaaggaguggaacuuaagucuggcuauaaagacuggauccuguggauuuccuuugccaucagcugcuuccuccugugcgucgugcugcucggguuuaucaugugggccugucagaagggaaacauucgcugcaauaucuguauuuga

SEQ ID NO: 183806 - RNA, 1701 nt, Artificial Sequence
  derived and/or modified sequence opt5 from hemagglutinin__InfluenzaA__ABD77862
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucuaucuacgugcaggccuccggcagagucacagugagcaccaaacggucccagcagacagugauuccgaauaucgggucucgccccugggucagaggaguuagcucccggauuagcaucuauuggaccauugugaagccuggcgauauccugcugaucaacucuaccgggaaucucauugcuccccgcggauacuucaagaucagauccggcaaaagcucuauuaugcggagcgacgccccuaucggcaacuguaacuccgagugcauuacacccaaugggucuaucccgaacgauaagccuuuucaaaaugugaaccgcaucacguauggagcuugucccagauacgucaaacagaauacccugaaacuugccacaggcaugcggaacgugccugaaaagcagacccgcgggauuuucggagcgaucgccggcuuuauugagaaugggugggaaggaaugguugacggcugguauggcuucagacaccagaacagcgaggggacaggacaagcugccgaucugaaguccacccaggcugccaucaaucagauuaacggcaaacucaaucggcugaucgagaagacgaacgaaaaguuucaucaaaucgagaaagaguucagcgaaguggaagggcgcauucaggaccuugagaaguacgucgaggauacaaaaaucgaccuguggucuuauaaugccgaacuccugguggcucuggagaaccagcacaccauugaucucaccgacuccgaaaugaauaagcuguucgagagaacacggaaacagcuuagagaaaacgcggaggauaugggaaacggcugcuuuaagaucuaccauaagugugacaaugccugcauugggagcauccgcaacggcaccuacgaccacgauguuuaucgggacgaggcucugaauaacagauuccaaauuaaaggaguggaacucaagucuggcuacaaagauuggauccuguggaucuccuuugccauuagcugcuuccuucugugugucgugcuccugggguuuaucaugugggccugccagaagggaaauauucgcuguaacaucugcauuuga

SEQ ID NO: 183807 - RNA, 1701 nt, Artificial Sequence
  derived and/or modified sequence opt5 from hemagglutinin__InfluenzaA__ABD77884
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagggcucuagcacagggagaauuugcgacuccccgcaccggauccuggaugggaaaaauuguacccucaucgacgcccugcugggcgauccccauugcgacggguuucagaacaaggagugggaucucuucgucgaacgcucuaaagccuauagcaauuguuacccuuaugacgugcccgauuacgcuucccugagaucucuuguugccagcuccggaacgcuggaguuuaacaaugagagcuucaacuggaccggcguggcucagaauggcacaucuuaugccugcaagcggcgcuccgucaagagcuuuuucucuagacucaacuggcugcacaaacuugaauacaaguauccugcgcugaaugugaccaugcccaacaaugacaaauuugauaagcucuacauuuggggaguucaucacccuuccacagacagcgaucaaaccucucuguacgugcaggccuccggacgggucacggugagcacaaaacgcucccagcagaccgugaucccgaacauuggcucuagacccuggguccgcgggguuagcucccggaucagcauuuauuggacaaucgugaagccuggagacauucugcucaucaacucuaccggcaaucugaucgcucccagaggguacuucaagauucgguccggaaaaagcucuaucaugcgcagcgacgccccuauugauaacuguaauuccgagugcaucacccccaacggcucuauuccgaaugacaagccuuuucaaaacgugaauagaaucacauauggcgcuuguccccgguacgucaaacagaacacgcuuaagcuggccaccgggaugcgcaaugugccugaaaaacagacaagaggaaucuucggcgcgauugccggguuuaucgagaacggaugggaaggcaugguugaugggugguauggauuccggcaccagaauagcgagggcaccggccaagcugccgaccucaaguccacacaggcugccauuaaccagaucaaugggaaacugaacagacuuauugagaagaccaaugaaaaguuucaucaaaucgagaaagaguucagcgaaguggaaggacgcauccaggaucuggagaaguacgucgaggacacgaaaauugaucucuggucuuauaacgccgaacugcugguggcucucgagaaccagcacacaaucgaccugaccgauuccgaaaugaauaaacuuuucgagcggaccagaaagcagcugcgcgaaaacgcggaggacaugggcaaugggugcuuuaagauuuaccauaagugugauaacgccugcaucggaagcauucggaauggcacauacgaccacgacguuuauagagaugaggcucucaacaaucgcuuccaaaucaaagggguggaacugaagucuggcuacaaagacuggauucuuuggaucuccuuugccaucagcugcuuccugcucugugucgugcugcugggauuuauuaugugggccugccagaagggcaacauccgguguaauauuugcaucuga

SEQ ID NO: 183808 - RNA, 1701 nt, Artificial Sequence
  derived and/or modified sequence opt5 from hemagglutinin__InfluenzaA__ABD77895
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaagucuuucuucuccagacucaacuggcugcacaaacuugaguacaaguauccugcgcugaaugugaccaugcccaacaaugacaaauuugauaagcucuacauuuggggcguucaucacccuagcacagacucugaucaaaccucccuguacgugcaggccagcgggcgggucacgguguccacaaaacgcucucagcagaccgugaucccgaacauuggaagcagacccuggguccggggcaucuccagccgcauuucuaucuauuggacaauuguuaagccuggggacauccugcucaucaacuccaccggaaaucugauugcucccagaggcuacuucaagauccggagcgggaaaucuagcauuaugcgcuccgacgccccuaucgauaacuguaauucugagugcauuacccccaacggaagcaucccgaaugacaagccuuuucaaaacgugaauagaaucacauauggcgcuuguccccgguacgugaaacagaacacgcuuaagcuggccaccggcaugcgcaaugucccugaaaaacagacaagagggauuuucggagcgaucgccggcuuuauugagaacgggugggaaggaaugguggauggcugguauggguuccggcaccaaaauuccgagggaaccggccaggcugccgaccucaagagcacacaggcugccaucaaccagauuucuggcaaacugaauagacuuaucgagaagaccaacgaaaaguuucaucaaaucgagaaagaauuuuccgagguugaagggcgcauucaggaucuggagaaguacguggaggacacgaaaaucgaucucuggagcuauaaugccgaacugcuggucgcucucgagaaccagcacacaauugaccugaccgauucugaaaugaacaagcuguucgagcggaccagaaaacagcugcgcgaaaaugcggaggacaugggaaacggcugcuuuaagaucuaccauaagugugauaaugccugcauuggguccauccggaacggaacauacgaccacgacguguauagagaugaggcucucaauaaccgcuuccaaauuaaaggcguugaacuuaagagcggguacaaagacuggauccuuuggaucuccuuugccauuucuugcuuccugcucugugugguccugcugggcuuuaucaugugggccugccagaagggaaauauucgguguaacaucugcauuuga

SEQ ID NO: 183809 - RNA, 1701 nt, Artificial Sequence; identical to SEQ ID NO: 183807
  derived and/or modified sequence opt5 from hemagglutinin__InfluenzaA__ABD77906

SEQ ID NO: 183810 - RNA, 1698 nt, Artificial Sequence
  derived and/or modified sequence opt5 from hemagglutinin__InfluenzaA__ABD77917
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagaaagcccuguaccacacagaaaaugcuuaugugagcgucguuuccucucauuacagcagacgguucacccccgagauugccaagcgcccuaaggugagagaucaggaagggcggaucaacuauuacuggacgcuucuggagcccggagacacaauuaucuuugaggcgaauggcaaccucauugccccucgcuaugcuuucgcccuguccagaggguuuggaagcggcaucauuaccucuaaugcucccauggaugaaugugacgccaaaugccagacaccgcaaggcgcgaucaacuccagccuuccuuuccagaaugugcaccccgucaccaucggggaguguccuaaguacgugcggucugccaaacugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccaaaagagcacgcagaacgccauuaauggcaucaccaacaaagucaauuccgugaucgaaaagaugaacacacaguuuaccgcuguugggaaagaguucaauaagcuggagcgcagaauggaaaaccucaacaagaaaguggaugacggauuccuggauauuuggacauauaaugcggagcuucugguccuccuggaaaacgagcggacccuugacuuucacgacagcaaugugaagaaccuguacgaaaaagucaagucucagcucaaaaauaacgccaaggagaucggcaaugggugcuucgaguuuuaucauaaguguaacaaugaaugcauggaguccgugaaaaacggcacguacgauuaucccaaguacagcgaagagucuaaacugaaucgcgagaagauugacggaguuaaacuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 183811 - RNA, 1698 nt, Artificial Sequence
  derived and/or modified sequence opt5 from hemagglutinin__InfluenzaA__ABD77928
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaagaaagugcugguccucuggggagugcaucacccuccgaacaucggcgaucagaaggcccuguaccacacagagaacgcuuaugugagcgucguuuccucucauuacagcagacgguucacccccgaaauugccaagcgcccuaaagugagagaccaggaggggcggaucaauuauuacuggacgcuucuggaacccggagauacaauuaucuuugaggcgaacggcaaucucauugccccucgcuaugcuuucgcccuguccagaggguuuggaagcggcaucauuaccucuaacgcucccauggacgagugugaugccaagugccagacaccgcaaggcgcgaucaauuccagccuuccuuuccagaacgugcaccccgucaccaucggggaauguccuaaauacgugcggucugccaagcugcgcaugguuaccggacucagaaauauucccagcauccagucccggggccuguuuggggcuauugccggauucaucgagggcggguggacaggaaugguggacggcugguauggcuaccaucaccagaacgaacaagggucuggauacgcugccgaucagaaaagcacgcagaaugccauuaacggcaucaccaauaaggucaacuccgugaucgagaaaaugaauacacaguuuaccgcuguugggaaggaguucaacaagcuggaacgcagaauggagaaucucaacaaaaagguggacgauggauuccuggacauuuggacauauaacgcggaacuucugguccuccuggagaaugaacggacccuugacuuucacgauagcaacgugaaaaaucuguacgagaaggucaaaucucaacucaagaacaaugccaaggaaaucggcaacgggugcuucgaguuuuaucauaaauguaauaacgagugcauggaauccgugaagaauggcacguacgacuaucccaaauacagcgaggaaucuaagcugaaccgcgagaaaauugauggaguuaagcuggaguccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183812 - RNA, 1698 nt, Artificial Sequence; identical to SEQ ID NO: 183766
  derived and/or modified sequence opt5 from hemagglutinin__InfluenzaA__ABD77939

SEQ ID NO: 183813 - RNA, 1698 nt, Artificial Sequence; identical to SEQ ID NO: 183766
  derived and/or modified sequence opt5 from hemagglutinin__InfluenzaA__ABD77950

SEQ ID NO: 183814 - RNA, 1698 nt, Artificial Sequence; identical to SEQ ID NO: 183765
  derived and/or modified sequence opt5 from hemagglutinin__InfluenzaA__ABD77961

SEQ ID NO: 183815 - RNA, 1698 nt, Artificial Sequence; identical to SEQ ID NO: 183766
  derived and/or modified sequence opt5 from hemagglutinin__InfluenzaA__ABD77983

SEQ ID NO: 183816 - RNA, 1698 nt, Artificial Sequence; identical to SEQ ID NO: 183766
  derived and/or modified sequence opt5 from hemagglutinin__InfluenzaA__ABD77994

SEQ ID NO: 183817 - RNA, 1698 nt, Artificial Sequence; identical to SEQ ID NO: 183765
  derived and/or modified sequence opt5 from hemagglutinin__InfluenzaA__ABD78005

SEQ ID NO: 183818 - RNA, 1698 nt, Artificial Sequence; identical to SEQ ID NO: 183765
  derived and/or modified sequence opt5 from hemagglutinin__InfluenzaA__ABD78016

SEQ ID NO: 183819 - RNA, 1698 nt, Artificial Sequence; identical to SEQ ID NO: 183766
  derived and/or modified sequence opt5 from hemagglutinin__InfluenzaA__ABD78027

SEQ ID NO: 183820 - RNA, 1698 nt, Artificial Sequence; identical to SEQ ID NO: 183766
  derived and/or modified sequence opt5 from hemagglutinin__InfluenzaA__ABD78038

SEQ ID NO: 183821 - RNA, 1701 nt, Artificial Sequence; identical to SEQ ID NO: 183801
  derived and/or modified sequence opt5 from hemagglutinin__InfluenzaA__ABD78049

SEQ ID NO: 183822 - RNA, 1698 nt, Artificial Sequence; identical to SEQ ID NO: 183320
  derived and/or modified sequence opt5 from hemagglutinin__InfluenzaA__ABD78060

SEQ ID NO: 183823 - RNA, 1698 nt, Artificial Sequence
  derived and/or modified sequence opt5 from hemagglutinin__InfluenzaA__ABD78071
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccggaggcuuuggcagcgggaucauuaccucuaacgcucccaugggagagugugacgccaagugccagacaccgcaaggcgcgaucaauuccagccuuccuuuccagaacgugcaccccgucaccaucggggaauguccuaaguacgugagaucugccaaacugcggaugguuaccggacuccgcaauauucccagcauccaguccagaggccuguuuggggcuauugccggauucaucgagggcggcuggacagggaugguggauggaugguauggcuaccaucaccagaacgaacaagggucuggauacgcugccgaccaaaagagcacgcagaaugccauuaacggcaucaccaauaaagucaacuccgugaucgagaagaugaauacacaguuuaccgcuguugggaaagaguucaacaagcuggaacggcgcauggagaaucucaacaaaaagguggaugacggcuuccuggauauuuggacauauaacgcggaacuucugguccuccuggagaaugaaagaacccuugacuuucacgacagcaacgugaagaaucuguacgagaaagucaagucucagcucaaaaacaaugccaaggaaaucggaaacggcugcuucgaguuuuaucauaaauguaauaacgagugcauggaauccgugaagaaugggacguacgauuaucccaaguacagcgaggaaucuaaacugaaccgggagaagauugacggaguuaaacuggaguccaugggcguguaucagauccucgcuauuuacagcacagucgccuccucucuggugcuucugguuagccucggggccaucuccuucuggaugugcucuaauggaagccugcagugucgcaucugcauuuga

SEQ ID NO: 183824 - RNA, 1698 nt, Artificial Sequence
  derived and/or modified sequence opt5 from hemagglutinin__InfluenzaA__ABD78093
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccaugggggagugugacgccaagugccagacaccgcaaggagcgaucaauuccagccuuccuuuccagaacgugcaccccgucaccaucggcgaauguccuaaguacgugcggucugccaaacugcgcaugguuaccgggcucagaaauauucccagcauccagucccggggacuguuuggcgcuauugccggguucaucgagggaggcuggacaggcaugguggaugggugguauggauaccaucaccagaacgaacaaggcucuggguacgcugccgaccaaaagagcacgcagaaugccauuaacggaaucaccaauaaagucaacuccgugaucgagaagaugaauacacaguuuaccgcuguuggcaaagaguucaacaagcuggaacgcagaauggagaaucucaacaaaaagguggaugacggguuccuggauauuuggacauauaacgcggaacuucugguccuccuggagaaugaacggacccuugacuuucacgacagcaacgugaagaaucuguacgagaaagucaagucucagcucaaaaacaaugccaaggaaaucggcaacggaugcuucgaguuuuaucauaaauguaauaacgagugcauggaauccgugaagaauggcacguacgauuaucccaaguacagcgaggaaucuaaacugaaccgcgagaagauugacgggguuaaacuggaguccaugggaguguaucagauccucgcuauuuacagcacagucgccuccucucuggugcuucugguuagccucggcgccaucuccuucuggaugugcucuaaugggagccugcaguguagaaucugcauuuga

SEQ ID NO: 183825 - RNA, 1701 nt, Artificial Sequence
  derived and/or modified sequence opt5 from hemagglutinin__InfluenzaA__ABD78115
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucucuguacgugcaggccuccggcagagucacagugagcaccaaacggucccagcagacagugaucccgaauauugggucucgccccugggucagaggaguuagcucccggaucagcauuuauuggaccaucgugaagccuggcgauauucugcucaucaacucuaccgggaaucugaucgcuccccgcggauacuucaagauuagauccggcaaaagcucuaucaugcggagcgacgccccuauuggcaacuguaacuccgagugcaucacacccaaugggucuauuccgaacgauaagccuuuucaaaaugugaaccgcaucacguauggagcuugucccagauacgucaaacagaauacccuuaagcuggccacaggcaugcggaacgugccugaaaaacagacccgcgggaucuucggagcgauugccggcuuuaucgagaaugggugggaaggaaugguugacggcugguauggcuucagacaccagaacagcgaggggacaggacaagcugccgaucucaaguccacccaggcugccauuaaucagaucaacggcaaacugaaucggcuuauugagaagacgaacgaaaaguuucaucaaaucgagaaagaguucagcgaaguggaagggagaauccaggaccuggagaaguacgucgaggauacaaaaauugaccucuggucuuauaaugccgaacugcugguggcucucgagaaccagcacaccaucgaucugaccgacuccgaaaugaauaaacuuuucgagcgcacacggaagcagcugagagaaaacgcggaggauaugggaaacggcugcuuuaagauuuaccauaagugugacaaugccugcaucgggagcauucgcaacggcaccuacgaccacgauguuuaucggaaugaggcucucaacaauagauuccaaaucaaaggaguggaacugaagucuggcuacaaagacuggauucuuuggaucuccuuugccaucagcugcuuccugcucugugucgugcugcugggguuuauuaugugggccugccagaagggaaacauccgcuguaauauuugcaucuga

SEQ ID NO: 183826 - RNA, 1701 nt, Artificial Sequence
  derived and/or modified sequence opt5 from hemagglutinin__InfluenzaA__ABD78126
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucucuguacgugcaggccuccggcagagucacagugagcaccaaacggucccagcagacagugaucccgaauauugggucucgccccugggucagaggaguuagcuccaucauuagcaucuauuggaccauugugaagccuggcgauauccugcucaucaacucuaccgggaaucugauugcuccccggggauacuucaagauccgcuccggcaaaagcucuauuaugagaagcgacgccccuaucggcaacuguaacuccgagugcauuacacccaaugggucuaucccgaacgauaagccuuuucaaaaugugaaccggaucacguauggagcuuguccccgcuacgucaaacagaauacccuuaagcuggccacaggcaugagaaacgugccugaaaaacagacccgggggauuuucggagcgaucgccggcuuuauugagaaugggugggaaggaaugguugacggcugguauggcuuccgccaccagaacagcgaggggacaggacaagcugccgaucucaaguccacccaggcugccaucaaucagauuaacggcaaacugaauagacuuaucgagaagacgaacgaaaaguuucaucaaaucgagaaagaguucagcgaaguggaagggcggauucaggaccuggagaaguacgucgaggauacaaaaaucgaccucuggucuuauaaugccgaacugcugguggcucucgagaaccagcacaccauugaucugaccgacuccgaaaugaauaaacuuuucgagagaacacgcaagcagcugcgggaaaacgcggaggauaugggaaacggcugcuuuaagaucuaccauaagugugacaaugccugcauugggagcaucagaaacggcaccuacgaccacgauguuuaucgcgacgaggcucucaauaaccgguuccaaauuaaaggaguggaacugaagucuggcuacaaagauuggauccuuuggaucuccuuugccauuagcugcuuccugcucugugucgugcugcugggguuuaucaugugggccugccagaagggaaauauuagauguaacaucugcauuuga

SEQ ID NO: 183827 - RNA, 1701 nt, Artificial Sequence
  derived and/or modified sequence opt5 from hemagglutinin__InfluenzaA__ABD79032
augaagaccaucauugcccugagcuacaucuucugccucgugcugggccaggacuuucccgggaacgauaauuccacagcuacgcuuugucugggacaccaugccgucccuaacggcacccucguuaaaacaauuaccaaugaccaaaucgaggugacaaacgcgaccgaacuggugcagucuagcuccacagggaagauuugcaauaacccgcacagaauccuugauggaaucgacuguacccugauugaugcucuccugggcgacccccauugcgauggguuccagaaugagacgugggaccuguuugucgaacggucuaaagccuucagcaacuguuauccuuacgaugugcccgacuaugccucccuccgcucucugguugcuagcuccggaacccuugaguuuaucagcgaaggcuucacauggaccggcgugacacagaaugggggaucuaacgccugcaagagaggcccugauauuggguuuuucucccggcugaauuggcucuacaaaagcggaucuaccuaucccguccugaacgugacgaugccuaauaacgacaauuuugauaagcuguacaucuggggcguucaccauccguccacagaccaagagcagaccagccuguaugugcaggcuucugggcgcgucacaguguccaccaagagaagccagcaaaccauuauccccaacauuggaucccggccuugggugcgcggccucucuagcagaaucuccaucuacuggacaauugucaaacccggcgacauccugguuauuaacagcaaugggaaccugaucgccccucggggauacuucaagaugcgcacgggcaaaucuuccauuaugagaagcgaugcgcccaucgggaccuguaucucugagugcauuacaccgaauggaagcaucccuaacgacaagcccuuucagaaugugaacaaaauuaccuauggcgccuguccuaaguacgugaagcagaauacacucaaacuggcuaccgggaugcggaacguccccgaaaagcagacgcgcggacuuuucuccgccaucgcuggcuuuauugagaauggcugggaagggaugaucgauggaugguauggcuucagacaccaaaacucugaggggacaggacaggccgcggaccugaaaagcacccaggccgcuaucgaucaaauuaauggcaagcucaaccgggugaucgagaaaaccaaugaaaaguuccaccagauugagaaagaauuuuccgagguugaagggcgcauccaggaccuggagaaguacguggaggauacaaagauugaccuuuggagcuauaacgccgaacugcucgucgcucuggagaaucagcauaccaucgaucugacagacucugaaaugaacaaacucuucgagaagacgagacggcaacugagagaaaacgccgaggauaugggcaauggaugcuuuaaaauuuaccacaagugugacaacgccugcaucggcuccauccgcaaugggaccuaugaccaugauguguaccgggacgaggcucuuaacaauagauuccagauuaaaggaguugaacuuaagagcggcuacaaggauuggauccucuggauuucuuuugcgaucuccugcuuccugcuuugugugguccugcucggguuuauuaugugggccugccagaaaggaaacauccgcuguaauaucugcauuuga

SEQ ID NO: 183828 - RNA, 1701 nt, Artificial Sequence
  derived and/or modified sequence opt5 from hemagglutinin__InfluenzaA__ABD79112
augaaggccaaacugcucauccugcuuugcgcucugagcgccaccgacgcggauacaauuuguaucggcuaccacgcuaacaauuccacggacaccguggauacaguccucgagaagaacguuaccgugacacauucugugaaucugcuugaagacagccacaacgggaaacugugcagacucaagggaauugccccgcugcagcugggcaaauguaauaucgccggguggauucucggaaacccugagugcgaaucccugcuuucuaagcggagcugguccuauaucgcugagacccccaauucugaaaacggcgccuguuaccccggggauuucgcugacuaugaggagcugcgcgaacaacucagcuccgucagcucuuuugagagauucgaaaucuuuccuaagggacgguccuggcccgagcauaauauugauaucggcgugacagccgcgugcagccacgccggcaaaucuuccuucuacaagaaccugcuuuggcugaccgagaaagacgggagcuauccuaaucucaacaagucuuacguuaauaaaaaggaaaaggaggugcugauucuguggggaguccaucaucccccuaacaucgaaaaucagaaaacgcucuaucgcaaggagaacgcuuacguguccguugugagcuccaacuacaauagacgguuuaccccggaaauugccgagcgccccaaagucagaggccaggcugggcggaucaacuauuacuggacacugcuugagccuggagauaccauuaucuucgaagccaauggcaaccugaucgcgcccugguaugccuuugcucucaaucgcgggauuggaucuggcaucauuacaagcaacgccuccauggacgagugugauaccaagugccagacgccucaaggcgcuaucaauagcucucugcccuuccagaacauucacccguuuacaaucggggaauguccuaaauacgugagauccaccaaacuucggauggugacaggacugcgcaauauccccagcauucagucuagaggccucuucggggccaucgccggauuuauugagggcgggugggacggaaugaucgauggcugguauggcuaccaccaccagaacgaacaagggagcggauaugcugcggaccagaaguccacccagaaugccauuaacggcaucaccaauaaggucaacucuguuaucgagaagaugaauacacaguucacggcuguggggaaagaguuuaacaagcuggaaaaacggauggagaaccugaauaagaaaguggacgauggauuccucgacauuuggaccuacaacgccgaacugcuuguccugcucgagaaugaacgcacacuggauuuccaugacagcaacgugaagaaucuuuacgagaagguuaaaaaccaacugagaaauaacgccaaggagaucggcaaugggugcuuugaguucuaucacaaauguaacaaugaaugcauggaauccgugaagaacggcaccuacgauuauccuaaauuuagcgaggagucuaagcucaaucgggaaaagauugacggagucaaacuggaguccaugggcguguaccagauccuggcuauuuauagcacaguugccucuucccucgugcugcuugucagccugggggcgaucuccuucuggaugugcucuaacggaagccuccaguguagaauuugcaucuga

SEQ ID NO: 183829 - RNA, 1701 nt, Artificial Sequence
  derived and/or modified sequence opt5 from hemagglutinin__InfluenzaA__ABD79123
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaaggagugggaucucuucgucgaacggagcacggccuauuccaauuguuacccuuaugacgugcccgauuacgcuucucugcgcagccuuguugccuccagcgggacccuggaguuuacaaaagaaggauucaacuggaccggcguggcucaagacggcacaucuuaugccugcaagagaggguccgucaagagcuuuuucucucggcucaauuggcugcacaaacuugaguacaaguauccugcgcugaacgugaccaugcccaauaacgauaaauuugacaagcucuacauuuggggaguucaucacccuuccacggauagcgaccagacaucucuguacgugcaggccuccggccgcgucaccgugagcacaaaaagaucccagcaaaccgugaucccgaauauugggucucggcccuggguccgcggaguuagcuccagaaucagcauuuauuggaccaucgugaagccuggcgacauucugcucaucaacucuacagggaaucugaucgcuccccggggauacuucaagauucgcuccggcaaaagcucuaucaugagaagcgaugccccuauugacaacuguaacuccgagugcaucacgcccaauggcucuauuagcaacgauaagccguuucagaaugugaaccggaucaccuauggggcuuguccucgcuacgucaaacagaauacacuuaagcuggccaccggaaugagaaacgugcccgaaaaacagacacggggcaucuucggggcgauugccggauuuaucgagaauggcugggaagggaugguugacggaugguauggcuuccgccaccaaaacuccgagggcaccgggcaggcugccgaucucaagagcacgcaggcugccauuaaucaaaucaacggaaaacugaauagacuuauugagaagacaaacgaaaaguuucaucagaucgagaaagaguucucugaaguggaaggccggauccaggaccuggagaaguacgucgaggauaccaaaauugaccucugguccuauaaugccgaacugcugguggcucucgagaaccagcacaccaucgaucugacagacagcgaaaugaauaaacuuuucgagagaacccgcaagcaacugcgggaaaacgcggaggauauggggaacggaugcuuuagaauuuaccauaagugugacaaugccugcaucggcucuauucgcaacgggacauacgaccacgauguuuaucgggacgaggcucucaauaacagauuccagaucaagggcguggaacugaaauccggauacaaggauuggauucuuuggaucagcuuugccaucuccugcuuccugcucugugucgugcugcugggcuuuauuaugugggccugccagaaagggaauauccgcuguaacauuugcaucuga

SEQ ID NO: 183830 - RNA, 1701 nt, Artificial Sequence
  derived and/or modified sequence opt5 from hemagglutinin__InfluenzaA__ABD79134
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaagaaaugggaucucuucgucgagcggagcacggccuauuccaauuguuacccuuaugacgugcccgauuacgcuucucugcgcagccuuguugccuccagcgggacccuggaauuuacaaaggagggauucaacuggaccggcguggcucaagacggcacaucuuaugccugcaagagaggguccgucaagagcuuuuucucucggcucaauuggcugcacaaacuugaauacaaauauccugcgcugaacgugaccaugcccaauaacgauaaguuugacaaacucuacauuuggggaguucaucacccuuccacggauagcgaccagacaucucuguacgugcaggccuccggccgcgucaccgugagcacaaagagaucccagcaaaccgugaucccgaauauugggucucggcccuggguccgcggaguuagcuccagaaucagcauuuauuggaccaucgugaagccuggcgacauucugcucaucaacucuacagggaaucugaucgcuccccggggauacuucaaaauucgcuccggcaagagcucuaucaugagaagcgaugccccuauugacaacuguaacuccgagugcaucacgcccaauggcucuauuagcaacgauaaaccguuucagaaugugaaccggaucaccuauggggcuuguccucgcuacgucaagcagaauacacuuaaacuggccaccggaaugagaaacgugcccgagaagcagacacggggcaucuucggggcgauugccggauuuaucgaaaauggcugggaggggaugguugacggaugguauggcuuccgccaccaaaacuccgaaggcaccgggcaggcugccgaucucaaaagcacgcaggcugccauuaaucaaaucaacggaaagcugaauagacuuauugagaagacaaacgagaaauuucaucagaucgaaaaggaguucucugaaguggagggccggauccaggaccuggaaaaauacgucgaggauaccaagauugaccucugguccuauaaugccgagcugcugguggcucucgaaaaccagcacaccaucgaucugacagacagcgagaugaauaaacuuuucgaaagaacccgcaagcaacugcgggagaacgcggaagauauggggaacggaugcuuuaagauuuaccauaaaugugacaaugccugcaucggcucuauuagaaacgggacauacgaccacgauguuuaucgcgacgaggcucucaauaaccgguuccagaucaagggcguggagcugaaauccggauacaaggauuggauucuuuggaucagcuuugccaucuccugcuuccugcucugugucgugcugcugggcuuuauuaugugggccugccagaaagggaauaucagauguaacauuugcaucuga

SEQ ID NO: 183831 - RNA, 1701 nt, Artificial Sequence
  derived and/or modified sequence opt5 from hemagglutinin__InfluenzaA__ABD79145
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaaggagugggaucucuucgucgaacggagcacggccuauuccaauuguuacccuuaugacgugcccgauuacgcuucucugcgcagccuuguugccuccagcgggacccuggaguuuacaaaagaaggauucaacuggaccggcguggcucaagacggcacaucuuaugccugcaagagaggguccgucaagagcuuuuucucucggcucaauuggcugcacaaacuugaguacaaguauccugcgcugaacgugaccaugcccaauaacgauaaauuugacaagcucuacauuuggggaguucaucacccuuccacggauagcgaccagacaucucuguacgugcaggccuccggccgcgucaccgugagcacaaaaagaucccagcaaaccgugaucccgaauauugggucucggcccuggguccgcggaguuagcuccagaaucagcauuuauuggaccaucgugaagccuggcgacauucugcucaucaacucuacagggaaucugaucgcuccccggggauacuucaagauucgcuccggcaaaagcucuaucaugagaagcgaugccccuauugacaacuguaacuccgagugcaucacgcccaauggcucuauuagcaacgauaagccguuucagaaugugaaccggaucaccuauggggcuuguccucgcuacgucaaacagaauacacuuaagcuggccaccggaaugagaaacgugcccgaaaaacagacacggggcaucuucggggcgauugccggauuuaucgagaauggcugggaagggaugguugacggaugguauggcuuccgccaccaaaacuccgagggcaccgggcaggcugccgaucucaagagcacgcaggcugccauuaaucaaaucaacggaaaacugaauagacuuauugagaagacaaacgaaaaguuucaucagaucgagaaagaguucucugaaguggaaggccggauccaggaccuggagaaguacgucgaggauaccaaaauugaccucugguccuauaaugccgaacugcugguggcucucgagaaccagcacaccaucgaucugacagacagcgaaaugaauaaacuuuucgagagaacccgcaagcaacugcgggaaaacgcggaggauauggggaacggaugcuuuaagauuuaccauaagugugacaaugccugcaucggcucuauuagaaacgggacauacgaccacgauguuuaucgcgacgaggcucucaauaaccgguuccagaucaaaggcguggaacugaaguccggauacaaagauuggauucuuuggaucagcuuugccaucuccugcuuccugcucugugucgugcugcugggcuuuauuaugugggccugccagaaggggaauaucagauguaacauuugcaucuga

SEQ ID NO: 183832 - RNA, 1701 nt, Artificial Sequence; identical to SEQ ID NO: 183831
  derived and/or modified sequence opt5 from hemagglutinin__InfluenzaA__ABD79156

SEQ ID NO: 183833 - RNA, 1701 nt, Artificial Sequence; identical to SEQ ID NO: 183047
  derived and/or modified sequence opt5 from hemagglutinin__InfluenzaA__ABD79167

SEQ ID NO: 183834 - RNA, 1701 nt, Artificial Sequence; identical to SEQ ID NO: 183831
  derived and/or modified sequence opt5 from hemagglutinin__InfluenzaA__ABD79178

SEQ ID NO: 183835 - RNA, 1701 nt, Artificial Sequence
  derived and/or modified sequence opt5 from hemagglutinin__InfluenzaA__ABD79189
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaaggagugggaucucuucgucgaacggagcacggccuauuccaauuguuacccuuaugacgugcccgauuacgcuucucugcgcagccuuguugccuccagcgggacccuggaguuuacaaaagaaggauucaacuggaccggcguggcucaagacggcacaucuuaugccugcaagagaggguccgucaagagcuuuuucucucggcucaauuggcugcacaaacuugaguacaaguauccugcgcugaacgugaccaugcccaauaacgauaaauuugacaagcucuacauuuggggaguucaucacccuuccacggauagcgaccagacaucucuguacgugcaggccuccggccgcgucaccgugagcacaaaaagaucccagcaaaccgugaucccgaauauugggucucggcccuggguccgcggaguuagcuccagaaucagcauuuauuggaccguggugaagccuggcgacauccugcucauuaacucuacagggaaucugaucgcuccccggggauacuucaagauccgcuccggcaaaagcucuauuaugagaagcgaugccccuaucgacuccuguaacucugagugcauuacgcccaacggcagcaucuccaaugauaagccguuucagaacgucaaucggauuaccuauggggcuuguccucgcuacgugaaacagaacacacuuaagcuggccaccggaaugagaaauguucccgaaaaacagacacggggcaucuucggggcgaucgccggauuuauugagaacggcugggaagggaugguggacggaugguauggcuuccgccaccaaaauagcgagggcaccgggcaggcugccgaucucaagucuacgcaggcugccaucaaccaaauuaauggaaaacugaacagacuuaucgagaagacaaaugaaaaguuucaucagauugagaaagaguucuccgaagucgaaggccggauccaggaccuggagaaguacguggaggauaccaaaaucgaccucuggagcuauaacgccgaacugcugguugcucucgagaaucagcacaccauugaucugacagacucugaaaugaacaagcuguucgagagaacccgcaaacaacugcgggaaaaugcggaggauauggggaacggaugcuuuaagaucuaccauaagugugacaacgccugcauuggcuccaucagaaaugggacauacgaccacgauguguaucgcgacgaggcucucaacaaucgguuccagauuaaaggcgucgaacuuaagagcggauacaaagauuggauccuuuggauuuccuuugccaucucuugcuuccugcucugugugguccugcugggcuuuaucaugugggccugccagaaggggaacauuagauguaauaucugcauuuga

SEQ ID NO: 183836 - RNA, 1701 nt, Artificial Sequence; identical to SEQ ID NO: 183831
  derived and/or modified sequence opt5 from hemagglutinin__InfluenzaA__ABD79200

SEQ ID NO: 183837 - RNA, 1701 nt, Artificial Sequence
  derived and/or modified sequence opt5 from hemagglutinin__InfluenzaA__ABD79211
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuucagaacaaggagugggaucucuucgucgaacggagcacggccuauuccaauuguuacccuuaugacgugcccgauuacgcuucucugcgcagccuuguugccuccagcgggacccuggaguuuacaaaagaaggauucaacuggaccggcguggcucaagacggcacaucuuaugccugcaagagaggguccgucaagagcuuuuucucucggcucaauuggcugcacaaacuugaguacaaguauccugcgcugaacgugaccaugcccaauaacgauaaauuugacaagcucuacauuuggggaguucaucacccuuccacggauagcgaccagacaucucuguacgugcaggccuccggccgcgucaccgugagcacaaaaagaucccagcaaaccgugaucccgaauauugggucucggcccuggauccgcggagucagcuccagaauuagcaucuauuggaccauuguuaagccuggcgacauccugcucaucaacucuacagggaaucugauugcuccccggggauacuucaagauccgcuccggcaaaagcucuauuaugagaagcgaugccccuaucgacaacuguaacuccgagugcauuacgcccaauggcucuaucagcaacgauaagccguuucagaaugugaaccggaucaccuauggggcuuguccucgcuacgugaaacagaauacacuuaagcuggccaccggaaugagaaacguccccgaaaaacagacacggggcauuuucggggcgaucgccggauuuauugagaauggcugggaagggaugguggacggaugguauggcuuccgccaccaaaacuccgagggcaccgggcaggcugccgaucucaagagcacgcaggcugccaucaaucaaauuaacggaaaacugaauagacuuaucgagaagacaaacgaaaaguuucaucagaucgagaaagaguucucugaaguugaaggccggauucaggaccuggagaaguacguggaggauaccaaaaucgaccucugguccuauaaugccgaacugcuggucgcucucgagaaccagcacaccauugaucugacagacagcgaaaugaauaaacuuuucgagagaacccgcaagcaacugcgggaaaacgcggaggauauggggaacggaugcuuuaagaucuaccauaagugugacaaugccugcauuggcucuaucagaaacgggacauacgaccacgauguguaucgcgacgaggcucucaauaaccgguuccagauuaaaggcguugaacugaaguccggauacaaagauuggauccuuuggaucagcuuugccauuuccugcuuccugcucugugugguccugcugggcuuuaucaugugggccugccagaaggggaauauuagauguaacaucugcauuuga

SEQ ID NO: 183838 - RNA, 1701 nt, Artificial Sequence; identical to SEQ ID NO: 183047
  derived and/or modified sequence opt5 from hemagglutinin__InfluenzaA__ABD79222

SEQ ID NO: 183839 - RNA, 1701 nt, Artificial Sequence; identical to SEQ ID NO: 183047
  derived and/or modified sequence opt5 from hemagglutinin__InfluenzaA__ABD79233

SEQ ID NO: 183840 - RNA, 1701 nt, Artificial Sequence
  derived and/or modified sequence opt5 from hemagglutinin__InfluenzaA__ABD79244
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggaugggaaaaauuguacccucaucgacgcccugcugggagauccccauugcgacggcuuuaagaacaaagagugggaucucuucgucgaacggagcacggccuauuccaauuguuacccuuaugacgugcccgauuacgcuucucugcgcagccuuguugccuccagcgggacccuggaguuuacaaacgaaggauucaauuggaccggcguggcucaggacggcacaucuuaugccugcaagagaggguccgucaagagcuuuuucucucggcucaacuggcugcacaaacuugaguacaaguauccugcgcugaaugugaccaugcccaacaaugauaaauuugacaagcucuacauuuggggaguucaucacccuuccacggauagcgaccaaacaucucuguacgugcaggccuccggccgcgucaccgugagcacaaaaagaucccagcagaccgugaucccgaacauugggucucggcccuggguccgcggaguuagcuccagaaucagcauuuauuggaccaucgugaagccuggcgacauucugcucaucaauucuacagggaaccugaucgcuccccggggauacuucaagauucgcuccggcaaaagcucuaucaugagaagcgaugccccuauugacaacuguaauuccgagugcaucacgcccaacggcucuauuccgaaugauaagccuuuucaaaacgugaaucggaucaccuauggggcuuguccccgcuacgucaaacagaacacacuuaagcuggccaccggaaugagaaaugugccugaaaaacagacacggggcaucuucggggcgauugccggauuuaucgagaacggcugggaagggaugguugacggaugguauggcuuccgccaccagaauagcgagggcaccgggcaagcugccgaucucaaguccacgcaggcugccauuaaccagaucaauggaaaacugaacagacuuauugagaagacaaaugaaaaguuucaucaaaucgagaaagaguucagcgaaguggaaggccggauccaggaccuggagaaguacgucgaggauaccaaaauugaccucuggucuuauaacgccgaacugcugguggcucucgagaaucagcacaccaucgaucugacagacuccgaaaugaacaaacuuuucgagagaacccgcaagcagcugcgggaaaacgcggaggauauggggaauggaugcuuuaagauuuaccauaagugugacaacgccugcaucggcagcauuagaaaugggacauacgaccacgauguuuaucgcgacgaggcucucaacaaucgguuccaaaucaaaggcguggaacugaagucuggauacaaagauuggauucuuuggaucuccuuugccaucagcugcuuccugcucugugucgugcugcugggcuuuauuaugugggccugccagaaggggaacaucagauguaauauuugcaucuga

SEQ ID NO: 183841 - RNA, 1701 nt, Artificial Sequence; identical to SEQ ID NO: 183267
  derived and/or modified sequence opt5 from hemagglutinin__InfluenzaA__ABD94734

SEQ ID NO: 183842 - RNA, 1701 nt, Artificial Sequence; identical to SEQ ID NO: 183654
  derived and/or modified sequence opt5 from hemagglutinin__InfluenzaA__ABD94745

SEQ ID NO: 183843 - RNA, 1701 nt, Artificial Sequence
  derived and/or modified sequence opt5 from hemagglutinin__InfluenzaA__ABD94767
augaagaccaucauugcccugagcuacauccucugccugguguucgcucagaaacuucccgucaacgacaauuccacagccacgcugugucucggccaccaugcgguuccuaacgggacccuggugaagacaauuaccaaugauaacaucgaggugacaaaugcuaccgaacuuguccaaucuagcuccacaggaagaauuugcgacucuccgcaccagauccuggauggcgagaacuguacccucaucgacgcccugcugggggauccccauugcgacggauuucagaauaaagaaugggaucucuucguggagcggagcacggccuauuccaacuguuacccuuaugacguucccgauuacgcuucucugcgcagccuuguggccuccagcggcacccuggaauuuaauaacgagucuuucaauuggacaggggucgaccagaacggaaccuccagcgcuugcaagagacggucuaauaaauccuuuuucagccgccucaacuggcugcaccaacuuaaguauaaguacccugcccugaaugugacaaugcccaacaacgagaaauuugauaagcucuauauuuggggcguucaucacccuucuaccgacuccgaucagaucagccuguacgcgcaggccuccggcagagugacggucucuacaaaacggagccagcaaaaugugauuccgaacaucgggucccgccccugggugagaggagucagcucucggauuuccaucuacuggaccauuguuaagccuggcgacauccugcucaucaauagcacagggaaccugauugcuccccgcggauauuucaaaaucagaucuggcaagagcuccauuaugcggucuaaugccccuaucgggaaguguaacagcgaaugcauuacccccaauggauccaucccgaacgacaaaccuuuucagaaugugaaccgcaucaccuacggcgcuugucccagauaugugaagcagaauacacuuaaacuggccacgggcaugcggaacgucccugagaagcagacccgcgggauuuucggagcgaucgccggcuuuauugaaaaugggugggagggaaugguggauggcugguacggguucagacaccaaaacagcgagggaacaggccaggcugccgaccucaaaucuacccaggcugccaucaaucaaauuaacggcaagcugaaccggcuuaucgagaaaacaaaugaaaaguuucaucagaucgaaaaggaguucuccgaaguugaggggcgcauucaggaucuggagaaauauguggaagacaccaagaucgaucucuggagcuacaacgccgagcugcuggucgcucucgaaaaucagcacacgauugaccugacagauucugagaugaacaaacuuuucgaaagaacccggaagcaacugagagagaaugcggaggacaugggaaacggcugcuuuaaaaucuaucauaagugugauaaugccugcauuggguccauccgcaacggaaccuacgaccacgauguguaccgggacgaagcucucaauaacagauuccagauuaagggcguugagcugaaaagcggguauaaggacuggauccuuuggaucuccuuugccauuucuugcuuccugcucugugugguccugcugggcuuuaucaugugggccugccagaaaggaaauauucgcuguaacaucugcauuuga

SEQ ID NO: 183844 - RNA, 1698 nt, Artificial Sequence; identical to SEQ ID NO: 183824
  derived and/or modified sequence opt5 from hemagglutinin__InfluenzaA__ABD94778

SEQ ID NO: 183845 - RNA, 1698 nt, Artificial Sequence; identical to SEQ ID NO: 183824
  derived and/or modified sequence opt5 from hemagglutinin__InfluenzaA__ABD94789

SEQ ID NO: 183846 - RNA, 1701 nt, Artificial Sequence
  derived and/or modified sequence opt5 from hemagglutinin__InfluenzaA__ABD94822
augaagaccaucauugcccugagcuacauccucugccugguguucgcucagaaaauucccggcaacgacaauuccacagccacgcuuugucuggggcaccaugcggucccuaacggaacccucguuaagacaaucaccaaugaucaaauugaggugacaaacgcuaccgaacuggugcagucuagcuccacaggcagaaucugcgacucuccgcaccggauccuugauggggagaauuguacccugauugacgcccuccugggagauccccauugcgacggcuuucagaacaaagaaugggaucuguucgucgagcgcagcaaggccuauuccaauuguuacccuuaugacgugcccgauuacgcuucucucagaagccugguugccuccagcgggacgcuugaauuuaacaaugagucuuucaacuggaccggaguggcucagaauggcacauccuaugccugcaaacggagcucuaucaaguccuuuuucagccgccugaacuggcuccaccaacugaaguacaaauauccugcgcuuaaugucaccaugcccaacaaugacaaguuugauaaacuguacauuuggggcgugcaucacccuucuacagacuccgaucagaccagccucuacgcccaggcuuccgggagaguuacggugucuacaaagcggagccagcaaaccgucaucccgaacauuggaucccgccccugggugagaggcgugagcucucggaucuccauuuauuggacaaucgucaaaccuggggacauccugcugauuaacagcaccggaaaucucaucgcuccccgcggcuacuucaagauuagaucuggaaagagcuccaucaugcggucugacgccccuauugggaaauguaacagcgagugcaucacccccaauggcuccaucccgaacgauaagccuuuucagaauguuaaccgcauuacauauggcgccugucccagauacgugaaacagaauacgcugaaacuugcgaccgggaugcggaacgugccugaaaagcagacacgcggaaucuucggcgccauugcuggguuuaucgagaauggaugggaaggcauggucgacgggugguauggauucagacaccaaaacagcgagggcaccggccaggccgcugaucugaagucuacacaggccgccauuaaucaaaucaacgggaaacucaaucggcugaucgagaagaccaacgaaaaguuucaucagauugagaaagaguucuccgaaguggaaggaagaauccaggaccuugagaaguacguugaggauacgaaaauugaccuguggagcuauaaugcugaacuccugguggcgcuggagaaccagcacacaaucgaucucaccgacucugaaaugaacaagcuguucgagcgcacccggaaacaacuuagagaaaaugccgaggauaugggcaacgggugcuuuaagauuuaccauaagugugacaaugcuugcaucggauccauucgcaacggcacauacgaucacgacgucuaucgggacgaggcccugaauaacagauuccagaucaaagggguggaacucaagagcggcuacaaagauuggauccuguggauuuccuuugccaucucuugcuuccuucuguguguugugcuccugggauuuauuaugugggcuugccagaagggcaauauccgcuguaacauuugcaucuga

SEQ ID NO: 183847 - RNA, 1701 nt, Artificial Sequence
  derived and/or modified sequence opt5 from hemagglutinin__InfluenzaA__ABD94833
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccgacuguuacccuuaugaugugcccgacuacgcuucucugagaagccuuguugccuccagcgggacgcuggaguuuaccaaugaaggauucaacuggacaggcguggcucaggauggcaccucuuaugccugcaagcggggguccgucaagagcuuuuucucucgccucaauuggcugcacaaacuugaguacaaguauccugcgcugaacgugacaaugcccaauaacgacaaauuugauaagcucuacauuuggggaguucaucacccuuccaccgacagcgaccaaacgucucuguacgugcaggccuccggcagagucacagugagcaccaaacggucccagcagacagugaucccgaauauugggucucgccccugggucagaggaguuagcucccggaucagcauuuauuggaccaucgugaagccuggcgauauucugcucaucaacucuaccgggaaucugaucgcuccccgcggauacuucaagauuagauccggcaaaagcucuaucaugcggagcgacgccccuauuggcaacuguaacuccgagugcaucacacccaaugggucuauuccgaacgauaagccuuuucaaaaugugaaccgcaucacguauggagcuugucccagauacgucaaacagaauacccuuaagcuggccacaggcaugcggaacgugccugaaaaacagacccgcgggaucuucggagcgauugccggcuuuaucgagaaugggugggaaggaaugguugacggcugguauggcuucagacaccagaacagcgaggggacaggacaagcugccgaucucaaguccacccaggcugccauuaaucagaucaacggcaaacugaaucggcuuauugagaagacgaacgaaaaguuucaucaaaucgagaaagaguucagcgaaguggaagggagaauccaggaccuggagaaguacgucgaggauacaaaaauugaccucuggucuuauaaugccgaacugcugguggcucucgagaaccagcacaccaucgaucugaccgacuccgaaaugaauaaacuuuucgagcgcacacggaagcagcugagagaaaacgcggaggauaugggaaacggcugcuuuaagauuuaccauaagugugacaaugccugcaucgggagcauucgcaacggcaccuacgaccacgauguuuaucgggacgaggcucucaauaacagauuccaaaucaaaggaguggaacugaagucuggcuacaaagauuggauucuuuggaucuccuuugccaucagcugcuuccugcucugugucgugcugcugggguuuauuaugugggccugccagaagggaaauauccgcuguaacauuugcaucuga

SEQ ID NO: 183848 - RNA, 1701 nt, Artificial Sequence
  derived and/or modified sequence opt5 from hemagglutinin__InfluenzaA__ABD94844
augaagaccaucauugcccugagcuacauccucugcaugguguucgcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaacaaugaaucuuucaacuggaccggaguggcucagaauggcacauccuaugccugcaagcggcgcagcgucaagucuuucuucuccagacugaacuggcuccacaaacuggaguacaaguauccugcgcuuaaugugaccaugcccaacaaugacaaauuugauaagcuguacauuuggggcguucaucacccuagcacagacucugaucaaaccucccucuacgugcaggccagcgggcgggucacgguguccacaaaacgcucucagcagaccgugaucccgaacauuggaagcagacccuggguccggggcguuuccagcaucauuucuaucuauuggacaauugugaagccuggggacauccugcugaucaacuccaccggaaaucucauugcuccccgcggcuacuucaagaucagaagcgggaaaucuagcauuaugcgguccgacgccccuaucggaaacuguaauucugagugcauuacccccaacggcagcaucccgaaugauaagccuuuucaaaacgugaaucgcaucacauauggcgcuugucccagauacgucaaacagaacacgcugaagcuggccaccgggaugcggaaugugccugaaaaacagacacgcggaauuuucggcgcgaucgccggguuuauugagaacggaugggaaggcaugguugacgggugguauggauucagacaccaaaauuccgagggcaccggccaggcugccgaucuuaagagcacacaggcugccaucaaccagauuaaugggaaacucaaccggcugaucgagaagaccaaugaaaaguuucaucaaaucgagaaagaauuuucugagguggaaggacgcauucaggaccuugagaaguacgucgaggauacgaaaaucgaccugugguccuauaacgccgaacuccugguggcucuggagaaccagcacacaauugaucucaccgacagcgaaaugaauaagcuguucgagagaacccggaaacagcuuagagaaaacgcggaggauaugggcaaugggugcuuuaagaucuaccauaagugugacaacgccugcauuggaucuauccgcaauggcacauacgaucacgacguuuaucgggacgaggcucugaacaauagauuccaaauuaaagggguggaacucaaguccggcuacaaagauuggauccuguggaucagcuuugccauuuccugcuuccuucugugugucgugcuccugggauuuaucaugugggccugccagaagggcaacauucgcuguaauaucugcauuuga

SEQ ID NO: 183849 - RNA, 1701 nt, Artificial Sequence
  derived and/or modified sequence opt5 from hemagglutinin__InfluenzaA__ABD94855
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagggcucuagcacagggagaauuugcgacuccccgcaccggauccuggauggaaagaauuguacccucaucgacgcccugcugggcgauccccauugcgacggguuucagaacaaggagugggaucucuucgucgaacgcucuaaagccuauagcaauuguuacccuuaugacgugcccgauuacgcuucccugagaucucuuguugccagcuccggaacgcuggaguuuaacaaugagagcuucaacuggaccggcguggcucagaauggcacaucuuaugccugcaagcggggguccgucaagagcuuuuucucucgccucaacuggcugcacaaacuugaauacaaguauccugcgcugaaugugaccaugcccaacaaugacaaauuugauaagcucuacauuuggggaguucaucacccuuccacagacagcgaucaaaccucucuguacgugcaggccuccggcagagucacggugagcacaaaacggucccagcagaccgugaucccgaacauugggucucgccccugggucagaggaguuagcucccggaucagcauuuauuggacaaucgugaagccuggcgacauucugcucaucaacucuaccgggaaucugaucgcuccccgcggauacuucaagauuagauccggcaaaagcucuaucaugcggagcgacgccccuauugauaacuguaauuccgagugcaucacccccaacggcucuauuccgaaugacaagccuuuucaaaacgugaaucgcaucacauauggggcuugucccagauacgucaaacagaacacgcuuaagcuggccaccggaaugcggaaugugccugaaaaacagacacgcggcaucuucggggcgauugccggauuuaucgagaacggcugggaagggaugguugauggaugguauggcuucagacaccagaauagcgagggcaccgggcaagcugccgaccucaaguccacacaggcugccauuaaccagaucaauggaaaacugaaccggcuuauugagaagaccaaugaaaaguuucaucaaaucgagaaagaguucagcgaaguggaaggcagaauccaggaucuggagaaguacgucgaggacacgaaaauugaucucuggucuuauaacgccgaacugcugguggcucucgagaaccagcacacaaucgaccugaccgauuccgaaaugaauaaacuuuucgagcgcacccggaaacagcugagagaaaacgcggaggacauggggaauggaugcuuuaagauuuaccauaagugugauaacgccugcaucggcagcauucgcaaugggacauacgaccacgacguuuaucgggaugaggcucucaacaauagauuccaaaucaaaggcguggaacugaagucuggauacaaagacuggauucuuuggaucuccuuugccaucagcugcuuccugcucugugucgugcugcugggcuuuauuaugugggccugccagaaggggaacauccgcuguaauauuugcaucuga

SEQ ID NO: 183850 - RNA, 1701 nt, Artificial Sequence
  derived and/or modified sequence opt5 from hemagglutinin__InfluenzaA__ABD94866
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacgggccgcaccagauccuugauggaaagaauuguacccugaucgacgcccuccugggcgauccccauugcgacggguuucagaacaaggagugggaucuguucgucgaacggagcaaagccuauuccaauuguuacccuuaugacgugcccgauuacgcuucucuccgcagccugguugccuccagcggaacgcuugaguuuaccaacgaaucuuucaauuggacaggcguggcucaaaacggcaccuccuaugccugcaagagagggagcgucaagucuuucuucucccggcugaauuggcuccacaaacuggaguacaaguauccugcgcuuaacgugacaaugcccaauaacgacaaauuugauaagcuguacauuuggggaguucaucacccuagcaccgacucugaucagacgucccucuacgugcagagcuccggccgcaucacagucucuaccaaaagaagccagcaaacagugaccccgaauauugggucccggcccugggugcgcggagucagcucuagaaucuccauuuauuggaccaucguuaagccuggcgacauucugcugaucacaagcacggggaaccucaucgcuccccggggauacuucaagauucgcagaggcaaaucuagcaucaugcgguccgacgccccuauugauaacuguaauucugagugcaucacccccaacggcagcauuccgaaugacaagccuuuucagaacgugaaucgcaucacauauggggccugucccagauacgugaaacagaacacccugaaacuugcuacaggaaugcggaaugucccugaaaaacagacccgcggcaucuucggggccauugcgggauuuaucgagaacggcugggaagggaugguggauggaugguauggcuucagacaccaaaauuccgagggcacggggcaggccgcugaccucaagagcacacaggccgcuauuaaccaaaucaauggaaaacugaaccggcugauugagaagaccaaugaaaaguuucaucagaucgagaaagaauuuucugagguugaaggcagaauccaggaucuugagaaguacguggaggacaccaaaauugaucugugguccuauaacgccgaacuccuggucgcccuggagaaucagcacacaaucgaccucaccgauagcgaaaugaacaagcuguucgagcgcacacggaaacaacuuagagaaaacgcugaggacauggggaauggaugcuuuaagauuuaccauaagugugauaacgcgugcaucggcucuauucgcaaugggacguacgaccacgacguguaucgggaugaggcccugaacaauagauuccagaucaaaggcguugaacucaaguccggauacaaagacuggauucuguggaucagcuuugcuaucuccugcuuccuucugugugugguccuccugggcuuuauuaugugggccugccagaaggggaacauccgcuguaauauuugcaucuga

SEQ ID NO: 183851 - RNA, 1701 nt, Artificial Sequence
  derived and/or modified sequence opt5 from hemagglutinin__InfluenzaA__ABD94877
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaagucuuucuucuccagacucaacuggcugcacaaacuugaguacaaguauccugcgcugaaugugaccaugcccaacaaugacaaauuugauaagcucuacauuuggggcguucaucacccuagcacagacucugaucaaaccucccuguacgugcaggccagcgggcgggucacgguguccacaaaacgcucucagcagaccgugaucccgaacauuggaagcagacccuggguccggggcguuuccagccgcaucucuauuuauuggacaaucgugaagccuggggacauucugcucaucaacuccaccggaaaucugaucgcucccagaggcuacuucaagauucggagcgggaaaucuagcaucaugcgcuccgacgccccuauugauaacuguaauucugagugcaucacccccaacggaagcauuccgaaugacaagccuuuucaaaacgugaauagaaucacauauggcgcuuguccccgguacgucaaacagaacacgcuuaagcuggccaccggcaugcgcaaugugccugaaaaacagacaagagggaucuucggagcgauugccggcuuuaucgagaacgggugggaaggaaugguugauggcugguauggguuccggcaccaaaauuccgagggaaccggccaggcugccgaccucaagagcacacaggcugccauuaaccagaucaauggcaaacugaacagacuuauugagaagaccaaugaaaaguuucaucaaaucgagaaagaauuuucugagguggaagggcgcauccaggaucuggagaaguacgucgaggacacgaaaauugaucucugguccuauaacgccgaacugcugguggcucucgagaaccagcacacaaucgaccugaccgauagcgaaaugaauaaacuuuucgagcggaccagaaagcagcugcgcgaaaacgcggaggacaugggaaauggcugcuuuaagauuuaccauaagugugauaacgccugcaucgggucuauucggaauggaacauacgaccacgacguuuauagagaugaggcucucaacaaucgcuuccaaaucaaaggcguggaacugaaguccggguacaaagacuggauucuuuggaucagcuuugccaucuccugcuuccugcucugugucgugcugcugggcuuuauuaugugggccugccagaagggaaacauccgguguaauauuugcaucuga

SEQ ID NO: 183852 - RNA, 1701 nt, Artificial Sequence
  derived and/or modified sequence opt5 from hemagglutinin__InfluenzaA__ABD94888
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuuaagaacaaagagugggaucucuucgucgaacgcagcacggccuauuccaauuguuacccuuaugacgugcccgauuacgcuucucugagaagccuuguugccuccagcgggacccuggaguuuacaaacgaaggauucaauuggaccggcguggcucaggacggcacaucuuaugccugcaagcggggguccgucaagagcuuuuucucucgccucaacuggcugcacaaacuugaguacaaguauccugcgcugaaugugaccaugcccaacaaugauaaauuugacaagcucuacauuuggggaguucaucacccuuccacggauagcgaccagacaucucuguacgugcaagccuccggcagagucaccgugagcacaaaacggucccagcagaccgugaucccgaacauugggucucgccccugggucagaggaguuagcucccggaucagcauuuauuggaccaucgugaagccuggcgacauucugcucaucaauucuacagggaaccugaucgcuccccgcggauacuucaagauuagauccggcaaaagcucuaucaugcggagcgaugccccuauugacaacuguaauuccgagugcaucacgcccaacggcucuauuccgaaugauaagccuuuucagaacgugaaucgcaucaccuauggggcuugucccagauacgucaaacaaaacacacuuaagcuggccaccggaaugcggaaugugccugaaaaacagacacgcggcaucuucggggcgauugccggauuuaucgagaacggcugggaagggaugguugacggaugguauggcuucagacaccagaauagcgagggcaccgggcaggcugccgaucucaaguccacgcaagcugccauuaaccagaucaauggaaaacugaaccggcuuauugagaagacaaaugaaaaguuucaucagaucgagaaagaguucagcgaaguggaaggcagaauccaagaccuggagaaguacgucgaggauaccaaaauugaccucuggucuuauaacgccgaacugcugguggcucucgagaaucagcacaccaucgaucugacagacuccgaaaugaacaaacuuuucgagcgcacccggaagcagcugagagaaaacgcggaggauauggggaauggaugcuuuaagauuuaccauaagugugacaacgccugcaucggcagcauucgcaaugggacauacgaccacgauguuuaucgggacgaggcucucaacaauagauuccagaucaaaggcguggaacugaagucuggauacaaagauuggauucuuuggaucuccuuugccaucagcugcuuccugcucugugucgugcugcugggcuuuauuaugugggccugccaaaaggggaacauccgcuguaauauuugcaucuga

SEQ ID NO: 183853 - RNA, 1701 nt, Artificial Sequence; identical to SEQ ID NO: 183831
  derived and/or modified sequence opt5 from hemagglutinin__InfluenzaA__ABD94899

SEQ ID NO: 183854 - RNA, 1701 nt, Artificial Sequence
  derived and/or modified sequence opt5 from hemagglutinin__InfluenzaA__ABD94910
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagaauagcagcacaggcagaauuugcgacuccccgcaccggauccuggaugggaaaaacuguacccucaucgacgcccugcugggagauccccauugcgacggcuuucagaauaaggagugggaucucuucgucgaacgcucuaaagccuauagcaacuguuacccuuaugacgugcccgauuacgcuucccugagaucucuuguugccagcuccgggacgcuggaguuuaauaacgaaucuuucaauuggaccggaguggcucagaacggcacaucuuaugccugcaagcggcgcuccgucaagagcuuuuucucuagacucaauuggcugcacaaacuugaguacaaguauccugcgcugaacgugaccaugcccaauaacgacaaauuugauaagcucuacauuuggggcguucaucacccuuccacagacagcgaucaaaccucucuguacgugcaggccuccgggcgggucacggugagcacaaaacgcucccagcagaccgugaucccgaacauuggaucuagacccuggguccggggcguuagcucccgcaucagcauuuauuggacaaucgugaagccuggggacauucugcucaucaauucuaccggaaaccugaucgcucccagaggcuacuucaagauucgguccgggaaaagcucuaucaugcgcagcgacgccccuauuggaaauuguaacuccgagugcaucacccccaauggcucuauuccgaacgauaagccuuuucaaaaugugaacagaaucacauauggcgcuuguccccgguacgucaaacagaauacgcuuaagcuggccaccgggaugcgcaacgugccugaaaaacagacaagaggaaucuucggcgcgauugccggguuuaucgagaauggaugggaaggcaugguugacgggugguauggauuccggcaccagaacagcgagggcaccggccaagcugccgaucucaaguccacacaggcugccauuaaucagaucaacgggaaacugaauagacuuauugagaagaccaacgaaaaguuucaucaaaucgagaaagaguucagcgaaguggaaggacgcauccaggaccuggagaaguacgucgaggauacgaaaauugaccucuggucuuauaacgccgaacugcugguggcucucgagaaucagcacacaaucgaucugaccgacuccgaaaugaacaaacuuuucgagcggaccagaaagcagcugcgcgaaaaugcggaggauaugggcaacgggugcuuucggauuuaccauaagugugacaaugccugcaucggaagcauuagaaacggcacauacgaucacgacguuuaucgcgacgaggcucucaauaaccgguuccaaaucaaggggguggaacugaaaucuggcuacaaggauuggauucuuuggaucuccuuugccaucagcugcuuccugcucugugucgugcugcugggauuuauuaugugggccugccagaaaggcaauaucagauguaacauuugcaucuga

SEQ ID NO: 183855 - RNA, 1701 nt, Artificial Sequence
  derived and/or modified sequence opt5 from hemagglutinin__InfluenzaA__ABD94921
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacgggccgcaccagauccuggauggaaagaauuguacccucaucgacgcccugcugggcgauccccauugcgacggguuucagaacaaggagugggaucucuucgucgaacggucuaaagccuauagcaauuguuacccuuaugacgugcccgauuacgcuucccugcgcucucuuguugccagcuccggaacgcuggaguuuaccaacgagagcuucaauuggacaggcguggcucaaaacggcaccucuuaugccugcaagagaggguccgucaagagcuuuuucucucggcucaauuggcugcacaaacuugaauacaaguauccugcgcugaacgugacaaugcccaauaacgacaaauuugauaagcucuacauuuggggaguucaucacccuuccaccgacagcgaucagacgucucuguacgugcaguccagcggccgcgucacaguguccaccaaaagaucucagcaaacagugaccccgaauaucgggagccggcccuggguccgcggaguuuccagcagaauuucuaucuauuggaccauugugaagccuggcgacauccugcucauuaacuccacagggaaccugaucgcuccccggggauacuucaagauccgcagaggcaaaagcucuauuaugcggagcgacgccccuaucgauaauuguaacuccgagugcauuacgcccaauggcucuaucccgaacgacaagccuuuucagaaugugaaccgcauuaccuauggggccugucccagauacgucaaacagaauacacuuaagcuggcuaccggaaugcggaacgugccugaaaaacagacacgcggcaucuucggggccaucgcgggauuuauugagaauggcugggaagggaugguugauggaugguauggcuucagacaccaaaacagcgagggcaccgggcaggccgcugaccucaaguccacgcaggccgcuaucaaucaaauuaacggaaaacugaaucggcuuaucgagaagacaaacgaaaaguuucaucagauugagaaagaguucagcgaaguggaaggcagaauccaggaucuggagaaguacgucgaggacaccaaaaucgaucucuggucuuauaaugccgaacugcugguggcccucgagaaccagcacaccauugaccugacagauuccgaaaugaacaaacuuuucgagcgcacccggaaacaacugagagaaaaugcugaggacauggggaacggaugcuuuaagaucuaccauaagugugauaaugcgugcauuggcagcauccgcaacgggacauacgaccacgacguuuaucgggaugaggcccucaauaacagauuccagauuaaaggcguggaacugaagucuggauacaaagacuggauccuuuggauuuccuuugcuaucagcugcuuccugcucugugucgugcugcugggcuuuaucaugugggccugccagaaggggaauauucgcuguaacaucugcauuuga

SEQ ID NO: 183856 - RNA, 1701 nt, Artificial Sequence; identical to SEQ ID NO: 183831
  derived and/or modified sequence opt5 from hemagglutinin__InfluenzaA__ABD94932

SEQ ID NO: 183857 - RNA, 1698 nt, Artificial Sequence
  derived and/or modified sequence opt5 from hemagglutinin__InfluenzaA__ABD94943
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaaaagaaagaaguucugauucucuggggagugcaucacccuccgaacaucggcgaucagagaacccuguaccacacagagaacgcuuaugucagcgugguguccucucauuacagccggcgcuucacccccgaaauuacgaagagaccuaagguccgggaccaggaggggcgcaucaauuauuacuggacacuucuggaacccggagauaccauuaucuuugaggccaacggcaaucucauugcgccuugguaugccuucgcucuguccagaggguuuggaagcggcaucaucacaucuaacgcccccauggacgagugugaugcuaaaugccagaccccgcaaggcgccauuaauuccagccuuccuuuccagaacguucaccccgugaccaucggggaauguccuaaguacgugcggucugcgaaacugcgcauggucacaggacucagaaauauucccagcauccagucccggggccuguuuggggccauugcuggauucaucgagggcggguggacgggaaugguggacggcugguauggcuaccaucaccagaacgaacaagggucuggauacgccgcugaucaaaagagcacccagaaugccaucaacggcauuacaaauaaaguuaacuccgugaucgagaagaugaauacccaguuuacagccgucgggaaagaguucaacaagcuggaacgcagaauggagaaucucaacaagaaaguggacgauggauuccuggacauuuggaccuauaacgcugaacuucugguucuccuggagaaugaacggacgcuugacuuucacgauagcaacgugaagaaucuguacgagaaagucaagucucagcucaaaaacaaugcgaaggaaaucggcaacgggugcuucgaguuuuaucauaaguguaauaacgagugcauggaauccgugaaaaauggcacauacgacuaucccaaguacagcgaggaaucuaaacugaaccgcgagaagauugauggagucaaacuggacuccaugggcguguaucagauccucgccaucuacagcaccguugcuuccucucuggugcuucuggucagccucggggccauuuccuucuggaugugcucuaauggaagccugcaguguagaaucugcauuuga

SEQ ID NO: 183858 - RNA, 1701 nt, Artificial Sequence; identical to SEQ ID NO: 183657
  derived and/or modified sequence opt5 from hemagglutinin__InfluenzaA__ABD94954

SEQ ID NO: 183859 - RNA, 1698 nt, Artificial Sequence; identical to SEQ ID NO: 183766
  derived and/or modified sequence opt5 from hemagglutinin__InfluenzaA__ABD94965

SEQ ID NO: 183860 - RNA, 1698 nt, Artificial Sequence; identical to SEQ ID NO: 183765
  derived and/or modified sequence opt5 from hemagglutinin__InfluenzaA__ABD94987

SEQ ID NO: 183861 - RNA, 1698 nt, Artificial Sequence; identical to SEQ ID NO: 183765
  derived and/or modified sequence opt5 from hemagglutinin__InfluenzaA__ABD94998

SEQ ID NO: 183862 - RNA, 1698 nt, Artificial Sequence; identical to SEQ ID NO: 183765
  derived and/or modified sequence opt5 from hemagglutinin__InfluenzaA__ABD95009

SEQ ID NO: 183863 - RNA, 1698 nt, Artificial Sequence; identical to SEQ ID NO: 183766
  derived and/or modified sequence opt5 from hemagglutinin__InfluenzaA__ABD95020

SEQ ID NO: 183864 - RNA, 1698 nt, Artificial Sequence
  derived and/or modified sequence opt5 from hemagglutinin__InfluenzaA__ABD95031
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuuaccgacuaugaggaacugagagagcaacucuccucugucagcuccuucgaacgguuugagaucuuccccaaggagagcucuuggccuaaucauacagugaccggaguuuccgccagcugcucucacaacggcaaguccagcuuuuaccgcaaucugcuuuggcugacaggcaaaaacgggcucuaucccaaucugagacggucuuacgccaacaauaaggaaaaagaggugcugguccucuggggagugcaucacccuccgaacaucggcgaucagaaggcucuguaccacaccgaaaacgccuauguguccgucguuagcucccauuacucucgcagauucacgcccgagauugcuaaacggccuaaggugcgcgggcaggaaggaagaaucaauuauuacuggacacuucuggagcccggcgacaccauuaucuuugaggccaacgggaaucucauugcgccucgguaugccuucgcucugagccgcggauuuggcuccggcaucauuacaagcaacgcccccauggaugaaugugacgcuaagugccagaccccgcaaggggccaucaauucuucccuuccuuuccagaacgugcaccccgucaccaucggagaguguccuaaauacgugagaagcgcgaagcugcggaugguuacaggccuccgcaauauucccucuauccagagcagagggcuguuuggagccauugcuggcuucaucgaagggggauggacgggcaugguggauggcugguauggguaccaucaccagaacgagcaaggauccggcuacgccgcugaccagaaaucuacccagaaugccauuaacgggaucacaaauaaggucaacagcaucauugaaaagaugaauacccaguuuacagccgugggaaaagaguucaacaaacuggagcggcgcauggaaaaucucaacaagaagguugaugacggcuuccuggauaucuggaccuauaacgcugagcuucuggugcuccuggaaaaugagagaacgcuugacuuucacgacuccaacgucaaaaaucuguacgaaaaggugaaaagccaacucaagaacaaugcgaaagagauugggaacggcugcuucgaguuuuaucauaaguguaauaacgaaugcauggagucugucaagaauggaacauacgauuaucccaaauacuccgaagagagcaagcugaaccgggagaaaaucgacggcgugaagcuggaaucuauggggguuuaucagauucucgccaucuacuccaccguggcuagcucccugguccuucuggugucucucggagccaucagcuucuggaugugcuccaauggcucucugcaguguagaauuugcaucuga

SEQ ID NO: 183865 - RNA, 1698 nt, Artificial Sequence
  derived and/or modified sequence opt5 from hemagglutinin__InfluenzaA__ABD95042
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaagggcaaagaggugcugguccucuggggagugcaucacccuccgaacaucggggaucagagagcccuguaccacacagaaaacgcuuaugugagcgucguuuccucucauuacagccggcgcuucacccccgagauugccaagagaccuaaagugcgggaccaggaaggccgcaucaauuauuacuggacgcuucuggagcccggggauacaauuaucuuugaagcgaacggaaaucucauugccccuugguaugcuuucgcccuguccagaggcuuuggcagcgggaucauuaccucuaacgcucccaugggagagugugacgccaagugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggcuggacagggaugguggauggaugguauggcuaccaucaccagaacgagcaagggucuggauacgcugccgaccaaaagagcacgcagaaugccauuaacggcaucaccaauaaagucaacuccgugaucgaaaagaugaauacacaguuuaccgcuguugggaaagaguucaacaagcuggaacgcagaauggagaaucucaacaaaaagguggaugacggcuuccuggauauuuggacauauaacgcggagcuucugguccuccuggaaaaugagcggacccuugacuuucacgacagcaacgugaagaaucuguacgaaaaagucaagucucagcucaaaaacaaugccaaggagaucggaaacggcugcuucgaauuuuaucauaaauguaauaacgagugcauggaguccgugaagaaugggacguacgauuaucccaaguacagcgaagagucuaaacugaaccgcgaaaagauugacggaguuaaacuggaguccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183866 - RNA, 1698 nt, Artificial Sequence; identical to SEQ ID NO: 183865
  derived and/or modified sequence opt5 from hemagglutinin__InfluenzaA__ABD95053

SEQ ID NO: 183867 - RNA, 1698 nt, Artificial Sequence; identical to SEQ ID NO: 183824
  derived and/or modified sequence opt5 from hemagglutinin__InfluenzaA__ABD95064

SEQ ID NO: 183868 - RNA, 1698 nt, Artificial Sequence
  derived and/or modified sequence opt5 from hemagglutinin__InfluenzaA__ABD95075
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccaagggauuuggcagcggcaucauuaccucuaacgcucccaugggggagugugacgccaagugccagacaccgcaaggagcgaucaauuccagccuuccuuuccagaacgugcaccccgucaccaucggcgaauguccuaaauacgugagaucugccaagcugcggaugguuaccgggcuccgcaauauucccagcauccaguccagaggacuguuuggcgcuauugccggguucaucgagggaggcuggacaggcaugguggaugggugguauggauaccaucaccagaacgaacaaggcucuggguacgcugccgaccagaaaagcacgcagaaugccauuaacggaaucaccaauaaggucaacuccgugaucgagaaaaugaauacacaguuuaccgcuguuggcaaggaguucaacaaacuggaacggcgcauggagaaucucaacaagaagguggaugacggguuccuggauauuuggacauauaacgcggaacuucugguccuccuggagaaugaaagaacccuugacuuucacgacagcaacgugaaaaaucuguacgagaaggucaaaucucaacucaagaacaaugccaaagaaaucggcaacggaugcuucgaguuuuaucauaaguguaauaacgagugcauggaauccgugaagaauggcacguacgauuaucccaaauacagcgaggaaucuaagcugaaccgggagaaaauugacgggguuaagcuggaguccaugggaguguaucagauccucgcuauuuacagcacagucgccuccucucuggugcuucugguuagccucggcgccaucuccuucuggaugugcucuaaugggagccugcagugucgcaucugcauuuga

SEQ ID NO: 183869 - RNA, 1698 nt, Artificial Sequence; identical to SEQ ID NO: 183865
  derived and/or modified sequence opt5 from hemagglutinin__InfluenzaA__ABD95086

SEQ ID NO: 183870 - RNA, 1698 nt, Artificial Sequence; identical to SEQ ID NO: 183824
  derived and/or modified sequence opt5 from hemagglutinin__InfluenzaA__ABD95097

SEQ ID NO: 183871 - RNA, 1698 nt, Artificial Sequence
  derived and/or modified sequence opt5 from hemagglutinin__InfluenzaA__ABD95119
augaaggccaaacugcucauccugcuuugcaccuucacagcuacguacgccgacaccauuuguaucggcuaucacgcgaacaauagcacagauaccguggacacaguccuggagaagaacguuaccgugacacauuccgugaaucuccuggaagauucucacaacgggaaacuuugccugcucaagggaauugcuccccugcagcugggcaauuguagcgucgccggguggauccucggaaacccugagugcgaacugcuuauuuccaaagagucuuggagcuacaucguggaaaccccgaaucccgagaacggcacguguuauccuggguacuuugccgacuaugaggaacugagagagcaacucuccucuguuagcuccuucgaacgguuugagaucuuccccaagggaagcucuuggccuaaucauaccgugacaggcgucuccgcuagcugcucucacaacggcaaguccagcuuuuaccgcaaucugcuuuggcugaccgggaaaaacggacucuaucccaaucugucuauguccuacgugaacaauaaggagaaagaaguucuggugcucuggggcguccaucacccuccgaacauuggggaucagagagcccuguaccacacagagaacgcuuaugugagcguggucuccucucauuacagccggcgcuucacccccgaaaucgccaagagaccuaaaguucgggaccaggagggacgcauuaauuauuacuggacgcuucuggaacccggcgauacaaucauuuuugaggcgaacgggaaucucaucgccccuugguaugcuuucgcccuguccagaggauuuggcagcggcauuaucaccucuaacgcucccaugggggagugugacgccaagugccagacaccgcaaggagcgaucaauuccagccuuccuuuccagaacgugcaccccgugaccauuggcgaauguccuaaguacguccggucugccaaacugcgcauggugaccgggcucagaaauauccccagcauucagucccggggacuguuuggcgcuaucgccggguucauugagggaggcuggacaggcaugguugaugggugguauggauaccaucaccagaacgaacaaggcucuggguacgcugccgaccaaaagagcacgcagaaugccaucaacggaaucaccaauaaagugaacuccgucauugagaagaugaauacacaguuuaccgcugugggcaaagaguucaacaagcuggaacgcagaauggagaaucucaacaaaaagguugaugacggguuccuggauaucuggacauauaacgcggaacuucuggugcuccuggagaaugaacggacccuugacuuucacgacagcaacgucaagaaucuguacgagaaagugaagucucagcucaaaaacaaugccaaggaaauuggcaacggaugcuucgaguuuuaucauaaauguaauaacgagugcauggaauccgucaagaauggcacguacgauuaucccaaguacagcgaggaaucuaaacugaaccgcgagaagaucgacggggugaaacuggaguccaugggaguuuaucagauucucgcuaucuacagcacaguggccuccucucugguccuucuggugagccucggcgccaucuccuucuggaugugcucuaaugggagccugcaguguagaauuugcaucuga

SEQ ID NO: 183872 - RNA, 1698 nt, Artificial Sequence
  derived and/or modified sequence opt5 from hemagglutinin__InfluenzaA__ABD95130
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggaucuuaucccaaucucuccaugagcuacguuaacaauaaggagaaagaagugcugguccuguggggcgugcaucacccuccgaacaucggggaucagagagcccucuaccacacagagaacgcuuauguguccgucguuucuagccauuacucccggcgcuucacccccgaaauugccaagagaccuaaagugcgggaccaggagggacgcaucaauuauuacuggacgcugcuugaacccggcgauacaauuaucuuugaggcgaacgggaaucugauugccccuugguaugcuuucgcccucagcagaggauuuggcucuggcaucauuaccuccaacgcucccaugggggagugugacgccaagugccagacaccgcaaggagcgaucaauagcucucugccuuuccagaacgugcaccccgucaccaucggcgaauguccuaaguacgugcggagcgccaaacuucgcaugguuaccgggcugagaaauauucccuccauccagucucggggacucuuuggcgcuauugccggguucaucgagggaggcuggacaggcaugguggaugggugguauggauaccaucaccagaacgaacaaggcagcggguacgcugccgaccagaaguccacgcagaaugccauuaacggaaucaccaauaaagucaacagcgugaucgagaagaugaauacacaguuuaccgcuguuggcaaagaguucaacaagcuggaacgcagaauggagaaucugaacaaaaagguggaugacggguuccucgauauuuggacauauaacgcggaacugcuuguccugcucgagaaugaacggacccuggacuuucacgacucuaacgugaagaaucuuuacgagaaagucaagucccaacugaaaaacaaugccaaggaaaucggcaacggaugcuucgaguuuuaucauaaauguaauaacgagugcauggaaagcgugaagaauggcacguacgauuaucccaaguacucugaggaauccaaacucaaccgcgagaagauugacgggguuaaacuggagagcaugggaguguaucagauccuggcuauuuacuccacagucgccucuagccucgugcugcuuguuucccugggcgccaucucuuucuggaugugcagcaaugggucccuccaguguagaaucugcauuuga

SEQ ID NO: 183873 - RNA, 1698 nt, Artificial Sequence; identical to SEQ ID NO: 183824
  derived and/or modified sequence opt5 from hemagglutinin__InfluenzaA__ABD95141

SEQ ID NO: 183874 - RNA, 1698 nt, Artificial Sequence; identical to SEQ ID NO: 183824
  derived and/or modified sequence opt5 from hemagglutinin__InfluenzaA__ABD95152

SEQ ID NO: 183875 - RNA, 1698 nt, Artificial Sequence; identical to SEQ ID NO: 183871
  derived and/or modified sequence opt5 from hemagglutinin__InfluenzaA__ABD95163

SEQ ID NO: 183876 - RNA, 1698 nt, Artificial Sequence; identical to SEQ ID NO: 183865
  derived and/or modified sequence opt5 from hemagglutinin__InfluenzaA__ABD95174

SEQ ID NO: 183877 - RNA, 1698 nt, Artificial Sequence
  derived and/or modified sequence opt5 from hemagglutinin__InfluenzaA__ABD95185
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcgaguccagcuuuuaccgcaaucugcuuuggcugaccgggaagaacggacucuaucccaaucugucuauguccuacguuaacaauaaagaaaaggaggugcugguccucuggggcgugcaucacccuccgaacaucggggaucagagagcccuguaccacacagaaaacgcuuaugugagcgucguuuccucucauuacagccggcgcuucacccccgagauugccaaaagaccuaaggugcgggaccaggaaggacgcaucaauuauuacuggacgcuucuggagcccggcgauacaauuaucuuugaggcgaacgggaaucucauugccccuugguaugcuuucgcccuguccagaggauuuggcagcggcaucauuaccucuaacgcucccaugggggaaugugacgccaaaugccagacaccgcaaggagcgaucaauuccagccuuccuuuccagaacgugcaccccgucaccaucggcgaguguccuaaguacgugcggucugccaagcugcgcaugguuaccgggcucagaaauauucccagcauccagucccggggacuguuuggcgcuauugccggguucaucgaaggaggcuggacaggcaugguggaugggugguauggauaccaucaccagaacgagcaaggcucuggguacgcugccgaccagaaaagcacgcagaaugccauuaacggaaucaccaauaaggucaacuccgugaucgaaaagaugaauacacaguuuaccgcuguuggcaaagaguucaacaaacuggagcgcagaauggaaaaucucaacaagaaaguggaugacggguuccuggauauuuggacauauaacgcggagcuucugguccuccuggaaaaugagcggacccuugacuuucacgacagcaacgugaagaaucuguacgaaaaggucaaaucucaacucaagaacaaugccaaagagaucggcaacggaugcuucgaguuuuaucauaaguguaauaacgaaugcauggaguccgugaaaaauggcacguacgauuaucccaaguacagcgaagagucuaagcugaaccgcgagaaaauugacgggguuaagcuggaauccaugggaguguaucagauccucgcuauuuacagcacagucgccuccucucuggugcuucugguuagccucggcgccaucuccuucuggaugugcucuaaugggagccugcaguguagaaucugcauuuga

SEQ ID NO: 183878 - RNA, 1698 nt, Artificial Sequence; identical to SEQ ID NO: 183865
  derived and/or modified sequence opt5 from hemagglutinin__InfluenzaA__ABD95196

SEQ ID NO: 183879 - RNA, 1698 nt, Artificial Sequence; identical to SEQ ID NO: 183323
  derived and/or modified sequence opt5 from hemagglutinin__InfluenzaA__ABD95207

SEQ ID NO: 183880 - RNA, 1698 nt, Artificial Sequence; identical to SEQ ID NO: 183824
  derived and/or modified sequence opt5 from hemagglutinin__InfluenzaA__ABD95218

SEQ ID NO: 183881 - RNA, 1698 nt, Artificial Sequence; identical to SEQ ID NO: 183871
  derived and/or modified sequence opt5 from hemagglutinin__InfluenzaA__ABD95229

SEQ ID NO: 183882 - RNA, 1698 nt, Artificial Sequence; identical to SEQ ID NO: 183824
  derived and/or modified sequence opt5 from hemagglutinin__InfluenzaA__ABD95240

SEQ ID NO: 183883 - RNA, 1698 nt, Artificial Sequence; identical to SEQ ID NO: 183865
  derived and/or modified sequence opt5 from hemagglutinin__InfluenzaA__ABD95251

SEQ ID NO: 183884 - RNA, 1698 nt, Artificial Sequence; identical to SEQ ID NO: 183323
  derived and/or modified sequence opt5 from hemagglutinin__InfluenzaA__ABD95262

SEQ ID NO: 183885 - RNA, 1698 nt, Artificial Sequence; identical to SEQ ID NO: 183824
  derived and/or modified sequence opt5 from hemagglutinin__InfluenzaA__ABD95273

SEQ ID NO: 183886 - RNA, 1698 nt, Artificial Sequence; identical to SEQ ID NO: 183320
  derived and/or modified sequence opt5 from hemagglutinin__InfluenzaA__ABD95284

SEQ ID NO: 183887 - RNA, 1698 nt, Artificial Sequence; identical to SEQ ID NO: 183824
  derived and/or modified sequence opt5 from hemagglutinin__InfluenzaA__ABD95295

SEQ ID NO: 183888 - RNA, 1698 nt, Artificial Sequence
  derived and/or modified sequence opt5 from hemagglutinin__InfluenzaA__ABD95306
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaaauccuggugcucuggggcguccaucacccuccgaacauuggggaucagagagcccuguaccacacagagaacgcuuaugugagcguggucuccucucauuacagccggcgcuucacccccgaaaucgccaagagaccuaaaguucgggaccaggagggacgcauuaauuauuacuggacgcuucuggaacccggcgauacaaucauuuuugaggcgaacgggaaucucaucgccccuugguaugcuuucgcccuguccagaggauuuggcagcggcauuaucaccucuaacgcucccaugggggagugugacgccaagugccagacaccgcaaggagcgaucaauuccagccuuccuuuccagaacgugcaccccgugaccauuggcgaauguccuaaguacguccggucugccaaacugcgcauggugaccgggcucagaaauauccccagcauucagucccggggacuguuuggcgcuaucgccggguucauugagggaggcuggacaggcaugguugaugggugguauggauaccaucaccagaacgaacaaggcucuggguacgcugccgaccaaaagagcacgcagaaugccaucaacggaaucaccaauaaagugaacuccgucauugagaagaugaauacacaguuuaccgcugugggcaaagaguucaacaagcuggaacgcagaauggagaaucucaacaaaaagguugaugacggguuccuggauaucuggacauauaacgcggaacuucuggugcuccuggagaaugaacggacccuugacuuucacgacagcaacgucaagaaucuguacgagaaagugaagucucagcucaaaaacaaugccaaggaaauuggcaacggaugcuucgaguuuuaucauaaauguaauaacgagugcauggaauccgucaagaauggcacguacgauuaucccaaguacagcgaggaaucuaaacugaaccgcgagaagaucgacggggugaaacuggaguccaugggaguuuaucagauucucgcuaucuacagcacaguggccuccucucugguccuucuggugagccucggcgccaucuccuucuggaugugcucuaaugggagccugcaguguagaauuugcaucuga

SEQ ID NO: 183889 - RNA, 1698 nt, Artificial Sequence; identical to SEQ ID NO: 183865
  derived and/or modified sequence opt5 from hemagglutinin__InfluenzaA__ABD95328

SEQ ID NO: 183890 - RNA, 1701 nt, Artificial Sequence
  derived and/or modified sequence opt5 from hemagglutinin__InfluenzaA__ABD95339
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauuccguuaccagaggagugacggcuagcugcucucacaaaggcaaguccagcuuuuaucggaaccuccuguggcuuaccgagaaaaauggcuccuacccuaaccugucuaagagcuaugucaaugacaaggaaaaagaggugcucguucuguggggagugcaucaccccuccaacaucgaagaucagaagacaauuuaccgcaaagagaaugccuacgucagcguggugucuucccacuauaacagacgguucaccccugaaaucgcgaagcgcccgaaagucagagaccaggaggggcggauuaauuacuauuggacacugcucgagcccggcgauaccaucauuuuugaagccaacgggaaccugaucgcuccuugguacgccuucgcucuuagccgcggauuuggcucugggauuaucacgagcaauguuuccauggacgagugugaugccaagugccagacaccccaaggagcgaucaacucuagccugccuuuccagaaugugcaucccgugaccauuggcgaauguccgaaauaugucagauccacaaagcuccggauggugaccggccugcgcaacaucccuagcauucagucuagagggcuuuuuggagccaucgcuggcuucauugaagggggauggaccggcaugaucgacgggugguacggauaucaccaucagaaugaacaaggcuccggcuacgccgcugaucaaaagagcacacagaacgccaucaaugggauuacgaacaaaguuaauucugugaucgagaagaugaacacccaguuuacagccgucggaaaagaguucaauaagcuggaaaaacggauggagaaccucaauaagaagguggacgacggcuuccuggauauuuggaccuacaacgcugaacugcucguucugcuugagaaugaacgcacacuggacuuucacgauuccaacgugaaaaaccucuaugagaaggucaaaagccagcugaagaauaacgcgaaagagaucgggaauggaugcuucgaauuuuaccacaaguguaacaaugagugcauggaauccgugaagaacggcaccuaugacuaccccaaauauucugaggagagcaaacuuaauagagagaagauugauggggucaagcuggaguccaugggcguguaccagauccucgccaucuauucuacgguugcuagcucccuggugcugcucgucagccugggagccauuucuuucuggaugugcuccaacggcagccuucagugucggaucugcauuuga

SEQ ID NO: 183891 - RNA, 1698 nt, Artificial Sequence; identical to SEQ ID NO: 183766
  derived and/or modified sequence opt5 from hemagglutinin__InfluenzaA__ABE11657

SEQ ID NO: 183892 - RNA, 1698 nt, Artificial Sequence
  derived and/or modified sequence opt5 from hemagglutinin__InfluenzaA__ABE11668
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuauguccuacguuaacaauaaggaaaaagaggugcugguccucuggggagugcaucacccuccgaacaucggcgaucagagagcccuguaccacacagaaaacgcuuaugugagcgucguuuccucucauuacagccggcgcuucacccccgagauugccaagagaccuaaagugcgggaccaggaagggcgcaucaauuauuacuggacgcuucuggagcccggagauacaauuaucuuugaggcgaacggcaaucucauugccccuugguaugcuuucgcccuguccagaggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggguggacaggaaugguggacggcugguauggcuaccaucaccagaacgagcaagggucuggauacgcugccgaucaaaagagcacgcagaaugccauuaacggcaucaccaauaaagucaacuccgugaucgaaaagaugaauacacaguuuaccgcuguugggaaagaguucaacaagcuggagcgcagaauggaaaaucucaacaaaaagguggacgauggauuccuggacauuuggacauauaacgcggagcuucugguccuccuggaaaaugagcggacccuugacuuucacgauagcaacgugaagaaucuguacgaaaaagucaagucucagcucaaaaacaaugccaaggagaucggcaacgggugcuucgaguuuuaucauaaauguaauaacgaaugcauggaguccgugaagaauggcacguacgacuaucccaaguacagcgaagagucuaaacugaaccgcgagaagauugauggaguuaaacuggaauccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183893 - RNA, 1698 nt, Artificial Sequence
  derived and/or modified sequence opt5 from hemagglutinin__InfluenzaA__ABE11679
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcagaaacgggcucuaucccaaucugucuaaauccuacgcuaacaauaaggaaaaagaggugcugguccucuggggagugcaucacccuccgaacaucggcgaucagcgggcccuguaccacacagaaaacgcuuaugugagcgucguuuccucucauuacagccgcagauucacccccgagauugccaagcggccuaaagugcgcgaccaggaagggagaaucaauuauuacuggacgcuucuggagcccggagauacaauuaucuuugaggcgaacggcaaucucauugccccucgguaugcuuucgcccugucccgcggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaguacgugagaucugccaaacugcggaugguuaccggacuccgcaauauucccagcauccaguccagaggccuguuuggggcuauugccggauucaucgaaggcggguggacaggaaugguggacggcugguauggcuaccaucaccagaacgagcaagggucuggauacgcugccgaucaaaagagcacgcagaaugccauuaacggcaucaccaauaaagucaacuccgugaucgaaaagaugaauacacaguuuaccgcuguugggaaagaguucaacaagcuggagcggcgcauggaaaaucucaacaaaaagguggacgauggauuccuggacauuuggacauauaacgcggagcuucugguccuccuggaaaaugagagaacccuugacuuucacgauagcaacgugaagaaucuguacgaaaaagucaagucucagcucaaaaacaaugccaaggagaucggcaacgggugcuucgaguuuuaucauaaauguaaugacgaaugcauggaguccgugaagaacggcacguacgauuaucccaaguacagcgaagagucuaaacugaaucgggagaagauugacggaguuaaacuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 183894 - RNA, 1698 nt, Artificial Sequence
  derived and/or modified sequence opt5 from hemagglutinin__InfluenzaA__ABE11690
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcgaaugggaaccucauugccccuugguaugcuuucgcccuguccagaggauuuggcagcggcaucauuaccucuaaugcucccaugggggagugugaugccaagugccagacaccgcaaggagcgaucaacuccagccuuccuuuccagaaugugcaccccgucaccaucggcgaauguccuaaguacgugcggucugccaaacugcgcaugguuaccgggcucagaaacauucccagcauccagucccggggacuguuuggcgcuauugccggguucaucgagggaggcuggacaggcaugguggacgggugguauggauaccaucaccagaaugaacaaggcucuggguacgcugccgaucaaaagagcacgcagaacgccauuaauggaaucaccaacaaagucaauuccgugaucgagaagaugaacacacaguuuaccgcuguuggcaaagaguucaauaagcuggaacgcagaauggagaaccucaacaaaaagguggacgauggguuccuggacauuuggacauauaaugcggaacuucugguccuccuggagaacgaacggacccuugauuuucacgacagcaaugugaagaaccuguacgagaaagucaagucucagcucaaaaauaacgccaaggaaaucggcaauggaugcuucgaguuuuaucauaaauguaacaaugagugcauggaauccgugaagaacggcacguacgacuaucccaaguacagcgaggaaucuaaacugaaucgcgagaagauugaugggguuaaacuggaguccaugggaguguaucagauccucgcuauuuacagcacagucgccuccucucuggugcuucugguuagccucggcgccaucuccuucuggaugugcucuaacgggagccugcaguguagaaucugcauuuga

SEQ ID NO: 183895 - RNA, 1698 nt, Artificial Sequence
  derived and/or modified sequence opt5 from hemagglutinin__InfluenzaA__ABE11701
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagaaggcccuguaccacacagagaacgcuuaugugagcgucguuuccucucauuacagcagacgguucacccccgaaauugccaaacgcccuaaggugagagaccaggagggacggaucaauuauuacuggacgcuucuggaacccggcgauacaauuaucuuugaggcgaacgggaaucucauugccccuugguaugcuuucgcccugucccgcggauuuggcagcggcaucauuaccucuaacgcucccaugggggagugugacgccaagugccagacaccgcaaggagcgaucaauuccagccuuccuuuccagaacgugcaccccgucaccaucggcgaauguccuaaauacgugagaucugccaagcugcggaugguuaccgggcuccgcaauauucccagcauccaguccagaggacuguuuggcgcuauugccggguucaucgagggaggcuggacaggcaugguggaugggugguauggauaccaucaccagaacgaacaaggcucuggguacgcugccgaccagaaaagcacgcagaaugccauuaacggaaucaccaauaaggucaacuccaucauugagaaaaugaauacacaguuuaccgcugugggcaaggaguucaacaaacuggaacggcgcauggagaaucucaacaagaagguugaugacggguuccuggauaucuggacauauaacgcggaacuucuggugcuccuggagaaugaaagaacccuugacuuucacgacagcaacgucaaaaaucuguacgagaaggugaaaucucaacucaagaacaaugccaaagaaauuggcaacggaugcuucgaguuuuaucauaaguguaauaacgagugcauggaauccgucaagaauggcacguacgauuaucccaaauacagcgaggaaucuaagcugaaccgggagaaaaucgacggggugaagcuggaguccaugggaguuuaucagauucucgcuaucuacagcacaguggccuccucucugguccuucuggugagccucggcgccaucuccuucuggaugugcucuaaugggagccugcagugucgcauuugcaucuga

SEQ ID NO: 183896 - RNA, 1698 nt, Artificial Sequence; identical to SEQ ID NO: 183824
  derived and/or modified sequence opt5 from hemagglutinin__InfluenzaA__ABE11712

SEQ ID NO: 183897 - RNA, 1698 nt, Artificial Sequence; identical to SEQ ID NO: 183865
  derived and/or modified sequence opt5 from hemagglutinin__InfluenzaA__ABE11723

SEQ ID NO: 183898 - RNA, 1698 nt, Artificial Sequence; identical to SEQ ID NO: 183871
  derived and/or modified sequence opt5 from hemagglutinin__InfluenzaA__ABE11734

SEQ ID NO: 183899 - RNA, 1698 nt, Artificial Sequence; identical to SEQ ID NO: 183824
  derived and/or modified sequence opt5 from hemagglutinin__InfluenzaA__ABE11812

SEQ ID NO: 183900 - RNA, 1698 nt, Artificial Sequence; identical to SEQ ID NO: 183865
  derived and/or modified sequence opt5 from hemagglutinin__InfluenzaA__ABE11823

SEQ ID NO: 183901 - RNA, 1698 nt, Artificial Sequence; identical to SEQ ID NO: 183865
  derived and/or modified sequence opt5 from hemagglutinin__InfluenzaA__ABE11834

SEQ ID NO: 183902 - RNA, 1698 nt, Artificial Sequence; identical to SEQ ID NO: 183865
  derived and/or modified sequence opt5 from hemagglutinin__InfluenzaA__ABE11845

SEQ ID NO: 183903 - RNA, 1698 nt, Artificial Sequence; identical to SEQ ID NO: 183871
  derived and/or modified sequence opt5 from hemagglutinin__InfluenzaA__ABE11856

SEQ ID NO: 183904 - RNA, 1701 nt, Artificial Sequence
  derived and/or modified sequence opt5 from hemagglutinin__InfluenzaA__ABE11900
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccaaucugucuaaguccuacgugaacaauaaagagaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgagugugacgccaagugccagaccccucaaggcgcuauuaauucuagccugcccuuucagaacgugcacccggugaccaucggggaauguccuaaauacguccgguccacaaagcuccgcauggugacgggacugagaaauauccccucuauucagagccggggccuuuucggggccaucgcuggauuuauugagggcggguggaccggaaugaucgauggcugguauggcuaccaucaccagaacgaacaaggguccggauacgccgccgaccagaaaagcacacagaaugcuauuaacggcaucaccaauaagguuaacucugugaucgagaaaaugaauacacaguucaccgcggucgggaaggaguucaacaagcuggaacgcagaauggagaaucucaacaaaaagguggaugacggauuucuggauauuuggacguauaacgccgaacugcucguucugcuugagaaugaacggacacuggacuuccacgacuccaacgugaaaaaucucuacgagaaggucaaaacccaacugaagaacaaugcuaaggagaucggcaacgggugcuuugaguucuaucauaaauguaauaacgaaugcauggaaagcgugaagaauggcaccuacgauuauccuaaauacucugaggaguccaaacuuaaccgcgagaaaauugacggagucaagcuggaaagcaugggcguguaucagauccucgccauuuacuccacaguugccucuagccuggugcugcucaucucccugggggcuaucucuuuuuggaugugcagcaauggaucccuucaguguagaauuugcaucuga

SEQ ID NO: 183905 - RNA, 1701 nt, Artificial Sequence
  derived and/or modified sequence opt5 from hemagglutinin__InfluenzaA__ABE11942
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccucucuguccaagagcuacgugaauaacaaagagaaggaaguucucgugcuguggggaguccaucacccuuccaauauuggggaucagagagccaucuaccacaccgagaacgcguaugugucuguggucagcucccauuacagccggcgcuuuacgccggaaaucgccaagagacccaaaguucgggaccaggagggccgcauuaacuauuacuggacacugcucgagccuggggauaccaucauuuucgaagcuaauggaaaccugaucgcccccugguaugcuuuugcccuuucuagaggcuucggguccggaauuaucacaagcaaugcgucuaugggcgagugugacgccaagugccagaccccucaaggcgcuauuaacagcucccugcccuuucagaaugugcacccggugaccaucggggaauguccuaaauacguccggucuacaaagcuccgcauggugacgggacugagaaacauccccagcauucagucccggggccuuuucggggccaucgcuggauuuauugagggcggguggaccggaaugaucgauggcugguauggcuaccaucaccagaaugaacaagggagcggauacgccgccgaccagaaaucuacacagaacgcuauuaauggcaucaccaacaagguuaauuccgugaucgagaaaaugaacacacaguucaccgcggucgggaaggaguucaauaagcuggaacgcagaauggagaaccucaauaaaaagguggaugacggauuucuggauauuuggacguauaacgccgaacugcucguucugcuugagaacgaacggacacuggacuuccacgacagcaaugugaaaaaccucuacgagaaggucaaaacccaacugaagaauaacgcuaaggagaucggcaaugggugcuuugaguucuaucauaaauguaacaaugaaugcauggaaucugugaagaacggcaccuacgauuauccuaaauacuccgaggagagcaaacuuaaucgcgagaaaauugacggagucaagcuggaauccaugggcguguaucagauccucgccauuuacucuacaguugccagcucccuggugcugcucgucucucugggggcuaucagcuuuuggaugugcuccaacggaagccuucaguguagaaucugcauuuga

SEQ ID NO: 183906 - RNA, 1701 nt, Artificial Sequence
  derived and/or modified sequence opt5 from hemagglutinin__InfluenzaA__ABE12078
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaaagaccaagaagcagcugagagagaacgccgaggacauggggaauggauguuuuaaaaucuaucauaagugcgauaacgcuugcauuggcucuauccgcaaugggaccuacgaccacgaugucuaccgggacgaagcccucaacaauagauuccagauuaaaggcguggagcugaaguccggauauaaagacuggauccuuuggaucagcuuugccauuuccuguuuccugcucugcguugugcugcugggcuuuaucaugugggcuugucagaaggggaacauucgcugcucuaucuguauuuga

SEQ ID NO: 183907 - RNA, 1701 nt, Artificial Sequence; identical to SEQ ID NO: 183801
  derived and/or modified sequence opt5 from hemagglutinin__InfluenzaA__ABE12123

SEQ ID NO: 183908 - RNA, 1698 nt, Artificial Sequence; identical to SEQ ID NO: 183824
  derived and/or modified sequence opt5 from hemagglutinin__InfluenzaA__ABE12248

SEQ ID NO: 183909 - RNA, 1701 nt, Artificial Sequence
  derived and/or modified sequence opt5 from hemagglutinin__InfluenzaA__ABE12623
augaagaccaucauugcccugagcuacaucuucugccucgugcugggccaggaccuucccgggaacgauaauuccacagcuacgcugugucucggacaccaugccgucccuaacggcacccugguuaaaacaauuaccaaugaccaaaucgaggugacaaacgcgaccgaacuugugcagucuagcuccacagggaagauuugcaauaacccgcacagaauccuggauggaaucgacuguacccucauugaugcucugcugggcgacccccauugcgauggguuucagaaugagacgugggaccucuucgucgaacggucuaaagccuuuagcaacuguuauccuuacgaugugcccgacuaugccucccugcgcucucuuguugcuagcuccggaacccuggaguucaucaaugaaggcuuuacauggaccggcgugacacagaacgggggaagcaaugccugcaagagaggcccugauucuggguucuuuucccggcucaacuggcuguacaaaagcggaucuaccuaucccguccuuaaugugacgaugccuaacaaugacaacuucgauaagcuguacauuuggggcguucaccauccguccacaaaccaagagcagaccagccucuaugugcaggcuucugggcgcgucacaguguccaccaagagaagccagcaaaccaucauucccaauaucggaucccggccuugggugcgcggccugucuagcagaauuuccaucuacuggacaaucgucaaacccggcgacauucugguuaucaacagcaaugggaaccucauugccccucggggauacuuuaagaugcgcacgggcaaaucuuccaucaugagaagcgacgcgcccauugggaccuguaucucugagugcaucacaccgaauggaagcauuccuaacgauaagcccuuccagaaugugaacaaaaucaccuauggcgccuguccuaaguacgugaagcagaauacacugaaacuugcuaccgggaugcggaacguccccgaaaagcagacgcgcggacuguuuggcgccauugcuggcuucaucgagaaugggugggaaggaaugauugacggcugguauggguuuagacaccaaaacuccgagggaacaggccaggccgcggaucucaaaucuacccaggccgcuaucgaccaaaucaaugggaagcugaaccgggugauugagaaaaccaaugaaaaguuccaccagaucgagaaagaguucagcgaaguugaaggccgcauucaggaucuugagaaguacguggaggacacaaagaucgaucugugguccuauaacgccgaacuccuggucgcucuggagaaccagcauaccauugaccucacagauagcgaaaugaauaaacuguuugagaagacgagacggcaacuuagagaaaacgccgaggacaugggaaauggcugcuuccgcaucuaccacaaaugugauaacgccugcauugggucuauccggaauggaaccuaugaccaugacguguacagagaugaggcucugaacaaucgcuuucagaucaagggcguugaacucaaauccggguacaaggacuggauucuguggaucagcuucgcgauuucuugcuuucuucugugugugguccuccugggauucaucaugugggccugccagaagggcaacauucgguguaauaucugcaucuga

SEQ ID NO: 183910 - RNA, 1701 nt, Artificial Sequence; identical to SEQ ID NO: 183854
  derived and/or modified sequence opt5 from hemagglutinin__InfluenzaA__ABE12645

SEQ ID NO: 183911 - RNA, 1701 nt, Artificial Sequence; identical to SEQ ID NO: 183831
  derived and/or modified sequence opt5 from hemagglutinin__InfluenzaA__ABE13076

SEQ ID NO: 183912 - RNA, 1701 nt, Artificial Sequence; identical to SEQ ID NO: 183807
  derived and/or modified sequence opt5 from hemagglutinin__InfluenzaA__ABE13323

SEQ ID NO: 183913 - RNA, 1701 nt, Artificial Sequence
  derived and/or modified sequence opt5 from hemagglutinin__InfluenzaA__ABE13471
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagaauagcagcacaggcagaauuugcgacuccccgcaccggauccuggaugggaaaaacuguacccucaucgacgcccugcugggagauccccauugcgacggcuuucagaauaaggagugggaucucuucgucgaacgcucuaaagccuauagcaacuguuacccuuaugacgugcccgauuacgcuucccugagaucucuuguugccagcuccgggacgcuggaguuuuauaaugaaucuuucaacuggaccggaguggcucagaauggcacaucuuacgccugcaagcggcgcuccgucaagagcuuuuucucuagacucaacuggcugcacaaacuugaguauaaguacccugcgcugaaugugaccaugcccaacaaugacaaauuugauaagcucuacauuuggggcguucaucacccuuccacagacagcgaucaaaccucucuguaugugcaggccuccgggcgggucacggugagcacaaaacgcucccagcagaccgugaucccgaacauuggaucuagacccuggguccggggcguuagcucccgcaucagcauuuacuggacaaucgugaagccuggggacauucugcucaucaacucuaccggaaaucugaucgcucccagaggcuauuucaagauucgguccgggaaaagcucuaucaugcgcagcgacgccccuauuggaaacuguaauuccgagugcaucacccccaacggcucuauuccgaaugauaagccuuuucaaaacgugaauagaaucacauacggcgcuuguccccgguaugucaaacagaacacgcuuaagcuggccaccgggaugcgcaaugugccugaaaaacagacaagaggaaucuucggcgcgauugccggguuuaucgagaacggaugggaaggcaugguugacgggugguacggauuccggcaccagaauagcgagggcaccggccaagcugccgaucucaaguccacacaggcugccauuaaccagaucaaugggaaacugaacagacuuauugagaagaccaaugaaaaguuucaucaaaucgagaaagaguucagcgaaguggaaggacgcauccaggaccuggagaaguaugucgaggauacgaaaauugaccucuggucuuacaacgccgaacugcugguggcucucgagaaccagcacacaaucgaucugaccgacuccgaaaugaauaaacuuuucgagcggaccagaaagcagcugcgcgaaaacgcggaggauaugggcaaugggugcuuucggauuuaccauaagugugacaacgccugcaucggaagcauuagaaauggcacauaugaucacgacguuuaccgcgacgaggcucucaacaaucgguuccaaaucaaggggguggaacugaaaucuggcuauaaggauuggauucuuuggaucuccuuugccaucagcugcuuccugcucugugucgugcugcugggauuuauuaugugggccugccagaaaggcaacaucagauguaauauuugcaucuga

SEQ ID NO: 183914 - RNA, 1701 nt, Artificial Sequence
  derived and/or modified sequence opt5 from hemagglutinin__InfluenzaA__ABE13555
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagggcucuagcacagggagaauuugcgacuccccgcaccggauccuggaugggaaaaauuguacccucaucgacgcccugcugggcgauccccauugcgacggguuucagaacaaggagugggaucucuucgucgaacgcucuaaagccuauagcaauuguuacccuuaugacgugcccgauuacgcuucccugagaucucuuguugccagcuccggaacgcuggaguuuaacaaugagagcuucaacuggaccggcguggcucagaauggcacaucuuaugccugcaagcggcgcuccgucaagagcuuuuucucuagacucaacuggcugcacaaacuugaauacaaguauccugcgcugaaugugaccaugcccaacaaugacaaauuugauaagcucuacauuuggggaguucaucacccuuccacagacagcgaucaaaccucucuguacgugcaggccuccggacgggucacggugagcacaaaacgcucccagcagaccgugaucccgaacauuggcucuagacccuggguccgcgggguuagcucccggaucagcauuuauuggacaaucgugaagccuggagacauucugcucaucucuuccaccggcaaccugaucgcucccagaggguacuucaagauucggagcggaaaaucuagcaucaugcgcuccgacgccccuauugauaauuguaacucugagugcaucacccccaauggcagcauuccgaacgacaagccuuuucaaaaugugaacagaaucacauauggcgcuuguccccgguacgucaaacagaauacgcuuaagcuggccaccgggaugcgcaacgugccugaaaaacagacaaagggaaucuucggcgcgauugccggguuuaucgagaauggaugggaaggcaugguugaugggugguauggauucagacaccagaacuccgagggcaccggccaagcugccgaccucaaaagcacacaggcugccauuaaucagaucaacgggaagcugaaucggcuuauugagaagaccaacgaaaaauuucaucaaaucgagaaggaguucucugaaguggaaggaagaauccaggaucuggagaaauacgucgaggacacgaagauugaucucugguccuauaaugccgaacugcugguggcucucgagaaccagcacacaaucgaccugaccgauagcgaaaugaacaaacuuuucgagcgcacccggaagcagcugagagaaaaugcggaggacaugggcaacgggugcuuuaagauuuaccauaaaugugauaaugccugcaucggaucuauucgcaacggcacauacgaccacgacguuuaucgggaugaggcucucaauaacagauuccaaaucaaggggguggaacugaaauccggcuacaaggacuggauucuuuggaucagcuuugccauguccugcuuccugcucugugucgugcugcugggauuuaucaugugggccugccagaaaggcaauauucgcuguaacaucugcauuuga

SEQ ID NO: 183915 - RNA, 1701 nt, Artificial Sequence
  derived and/or modified sequence opt5 from hemagglutinin__InfluenzaA__ABE13606
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaaauggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggacaggcguggcucaggacggcaccucuuaugccugcaagcggggguccgucaagagcuuuuucucucgccugaacuggcuccacaaacuggaguacaaguauccugcgcuuaaugugacaaugcccaacaaugauaaauuugacaagcuguacauuuggggaguucaucacccuuccaccgauagcgaccaaacgucucucuacgugcaggccuccggcagagucacagugagcaccaaacggucccagcagacagugaucccgaacauugggucucgccccugggucagaggaguuagcucccggaucagcauuuauuggaccaucgugaagccuggcgacauucugcugaucaauucuaccgggaaccucaucgcuccccgcggauacuucaagauuagauccggcaaaagcucuaucaugcggagcgaugccccuauuggcaacuguaauuccgagugcaucacacccaacgggucuauuccgaaugacaagccuuuucaaaacgugaaucgcaucacguauggagcuugucccagauacgucaaacagaacacccugaaacuugccacaggcaugcggaaugugccugaaaagcagacccgcgggaucuucggagcgauugccggcuuuaucgagaacgggugggaaggaaugguugauggcugguauggcuucagacaccagaauagcgaggggacaggacaagcugccgaccugaaguccacccaggcugccauuaaccagaucaauggcaaacucaaccggcugauugagaagacgaaugaaaaguuucaucaaaucgagaaagaguucagcgaaguggaagggagaauccaggaucuugagaaguacgucgaggacacaaaaauugaucuguggucuuauaacgccgaacuccugaucgcucuggagaaucagcacaccauugaccucaccgauuccgaaaugaacaagcuguucgagcgcacacggaaacagcuuagagaaaacgcggaggacaugggaaauggcugcuuuaagaucuaccauaagugugauaacgccugcauugggagcauccgcaauggcaccuacgaccacgacguguaucgggaugaggcucugaacaauagauuccaaauuaaaggaguugaacucaagucuggcuacaaagacuggauccuguggaucuccuuugccauuagcugcuuccuucugugugugguccuccugggguuuaucaugugggccugccagaagggaaacauucgcuguaauaucugcauuuga

SEQ ID NO: 183916 - RNA, 1701 nt, Artificial Sequence
  derived and/or modified sequence opt5 from hemagglutinin__InfluenzaA__ABE13628
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaacagcuuuuucucucgccucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccggcagagucacggugagcacaaaacggucccagcagaccgugaucccgaauauugggucucgccccugggucagaggaaucagcucccggauuagcaucuauuggacaauuguuaagccuggcgacauccugcucaucaacucuaccgggaaccugauugcuccccgcggauacuucaagaucagaaauggcaaauccagcauuaugcggucugaugccccuaucgacaacuguaauagcgagugcauuacccccaacggcuccaucccgaaugauaagccuuuucaaaacgugaaucgcaucacauauggggcuugucccagauacgugaaacagaacacgcuuaagcuggccaccggaaugcggaaugucccugaaaaacagacacgcggcauuuucggggcgaucgccggauuuauugagaacggcugggaagggaugguggacggaugguauggcuucagacaccaaaauucugagggcaccgggcaggcugccgaucucaagagcacacaggcugccaucgaccagauuaacggaaaacugaaucggcuuaucgagaagaccaacgaaaaguuucaucaaaucgagaaagaguucuccgaaguugaaggccgcauucaggaucuggagaaguacguggaggacacgaaaaucgaucucuggagcuauaaugccgaacugcuggucgcucucgagaaccagcacacaauugaccugaccgauucugaaaugaacaagcuguucgagagaacccggaaacagcugagagaaaaugcggaggacauggggaacggaugcuuuaagaucuaccauaagugugacaaugccugcauuggcuccauccgcaacgggacauacgaucacgacguguaucgggaugaggcucucaauaacagauuccaaauuaaaggcguugaacuuaagagcggauacaaagacuggauccuuuggaucucuuuugccauuuccugcuuccugcucugugugguccugcugggcuuuaucaugugggccugccagaaggggaauauucgcuguaacaucugcauuuga

SEQ ID NO: 183917 - RNA, 1701 nt, Artificial Sequence
  derived and/or modified sequence opt5 from hemagglutinin__InfluenzaA__ABE13824
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggacaggcguggcucaagacggcaagucuuaugccugcaagcggggguccgucaacagcuuuuucucucgccugaauuggcuccacaaacuggaguacaaguauccugcgcuuaacgugaccaugcccaauaacgauaaauuugacaagcuguacauuuggggaguucaucacccuuccacagauagcgaccagaccucucucuacgugcaggccuccggcagagucacggugagcacaaaacggucccagcaaaccgugaucccgaauauugggucucgccccugggucagaggaaucagcucccggauuagcaucuauuggacaauuguuaagccuggcgacauccugcugaucaacucuaccgggaaccucauugcuccccgcggauacuucaagaucagaaauggcaaauccagcauuaugcggucugaugccccuaucgacaacuguaauagcgagugcauuacccccaacggcuccaucccgaaugauaagccuuuucagaacgugaaucgcaucacauauggggcuugucccagauacgugaaacagaacacgcugaagcuggccaccggaaugcggaaugucccugaaaaacagacacgcggcauuuucggggcgaucgccggauuuauugagaacggcugggaagggaugguggacggaugguauggcuucagacaccaaaauucugagggcaccgggcaggcugccgaucuuaagagcacacaggcugccaucgaccaaauuaacggaaaacucaaucggcugaucgagaagaccaacgaaaaguuucaucagaucgagaaagaguucuccgaaguugaaggccgcauucaggaucuugagaaguacguggaggacacgaaaaucgaucuguggagcuauaaugccgaacuccuggucgcucuggagaaccagcacacaauugaccucaccgauucugaaaugaacaagcuguucgagagaacccggaaacaacuuagagaaaaugcggaggacauggggaacggaugcuuuaagaucuaccauaagugugacaaugccugcauuggcuccauccgcaacgggacauacgaucacgacguguaucgggaugaggcucugaauaacagauuccagauuaaaggcguugaacucaagagcggauacaaagacuggauccuguggaucucuuuugccauuuccugcuuccuucugugugugguccuccugggcuuuaucaugugggccugccagaaggggaauauucgcuguaacaucugcauuuga

SEQ ID NO: 183918 - RNA, 1701 nt, Artificial Sequence; identical to SEQ ID NO: 183917
  derived and/or modified sequence opt5 from hemagglutinin__InfluenzaA__ABE14019

SEQ ID NO: 183919 - RNA, 1701 nt, Artificial Sequence
  derived and/or modified sequence opt5 from hemagglutinin__InfluenzaA__ABE14030
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccauuggcagaaucugcgacucuccgcaccggauccuggaugggaaaaauuguacacucauugacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacccuggaguuuacgaacgaaggauucaauuggaccggcguggcucaggacggcaagucuuaugccugcaagcggggguccgucaacagcuuuuucucucgccucaauuggcugcacaaacuugaguacaaguauccugcgcugaacgugacaaugcccaauaacgauaaauuugacaagcucuacaucuggggaguucaucacccuuccaccgauagcgaccaaacaucucuguacgugcaggccuccggcagagucaccgugagcacgaaacggucccagcagacagugauuccgaauaucgggucucgccccugggucagaggaauuagcucccggaucagcauuuauuggaccaucguuaagccuggcgacauccugcucauuaacucuacagggaaccugaucgcuccccgcggauacuucaagauuagaaauggcaaauccagcaucaugcggucugaugccccuauugacaacuguaauagcgagugcaucacccccaacggcuccaucccgaaugauaagccuuuucaaaacgugaaucgcauuaccuauggggcuugucccagauacgugaaacagaacacacuuaagcuggccacgggaaugcggaaugucccugaaaaacagacccgcggcaucuucggggcgauugccggauuuaucgagaacggcugggaagggaugguggacggaugguauggcuucagacaccaaaauucugagggcacagggcaggcugccgaucucaagagcacccaggcugccauugaccagaucaacggaaaacugaaucggcuuaucgagaagacaaacgaaaaguuucaucaaauugagaaagaguucuccgaaguugaaggcagaauccaggaucuggagaaguacguggaggacaccaaaauugaucucuggagcuauaaugccgaacugcuggucgcucucgagaaccagcacacgaucgaccugacagauucugaaaugaacaagcuguucgagcgcacccggaaacagcugagagaaaaugcggaggacauggggaacggaugcuuuaagauuuaccauaagugugacaaugccugcaucggcuccauucgcaacgggaccuacgaucacgacguguaucgggaugaggcucucaauaacagauuccaaaucaaaggcguugaacuuaagagcggauacaaagacuggauccuuuggauuucuuuugccaucuccugcuuccugcucugugugguccugcugggcuuuauuaugugggccugccagaaggggaauauccgcuguaacauuugcaucuga

SEQ ID NO: 183920 - RNA, 1701 nt, Artificial Sequence; identical to SEQ ID NO: 183916
  derived and/or modified sequence opt5 from hemagglutinin__InfluenzaA__ABE14041

SEQ ID NO: 183921 - RNA, 1701 nt, Artificial Sequence; identical to SEQ ID NO: 183917
  derived and/or modified sequence opt5 from hemagglutinin__InfluenzaA__ABE14063

SEQ ID NO: 183922 - RNA, 1701 nt, Artificial Sequence
  derived and/or modified sequence opt5 from hemagglutinin__InfluenzaA__ABE14124
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgaccaaacgucucuguacgugcaggccuccggcagagucacagugagcaccaaacggucccagcagacagugaucccgaacauugggucucgccccugggucagaggaguuagcucccggaucagcauuuauuggaccaucgugaagccuggcgacauucugcucaucaauucuaccgggaaccugaucgcuccccgcggauacuucaagauuagauccggcaaaagcucuaucaugcggagcgaugccccuauuggcaacuguaauuccgagugcaucacacccaacgggucuauuccgaaugacaagccuuuucaaaacgugaaucgcaucacguauggagcuugucccagauacgucaaacagaacacccuuaagcuggccacaggcaugcggaaugugccugaaaaacagacccgcgggaucuucggagcgauugccggcuuuaucgagaacgggugggaaggaaugguugauggcugguauggcuucagacaccagaauagcgaggggacaggacaagcugccgaccucaaguccacccaggcugccauuaaccagaucaauggcaaacugaaccggcuuauugagaagacgaaugaaaaguuucaucaaaucgagaaagaguucagcgaaguggaagggagaauccaggaucuggagaaguacgucgaggacacaaaaauugaucucuggucuuauaacgccgaacugcugaucgcucucgagaaucagcacaccauugaccugaccgauuccgaaaugaacaaacuuuucgagcgcacacggaagcagcugagagaaaacgcggaggacaugggaaauggcugcuuuaagaucuaccauaagugugauaacgccugcauugggagcauccgcaauggcaccuacgaccacgacguguaucgggaugaggcucucaacaauagauuccaaauuaaaggaguugaacugaagucuggcuacaaagacuggauccuuuggaucuccuuugccauuagcugcuuccugcucugugugguccugcugggguuuaucaugugggccugccagaagggaaacauucgcuguaauaucugcauuuga

SEQ ID NO: 183923 - RNA, 1701 nt, Artificial Sequence
  derived and/or modified sequence opt5 from hemagglutinin__InfluenzaA__ABE14464
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggacaggcguggcucaagacggcaagucuuaugccugcaagcggggguccgucaacagcuuuuucucucgccugaauuggcuccacaaacuggaguacaaguauccugcgcuuaacgugaccaugcccaauaacgauaaauuugacaagcuguacauuuggggaguucaucacccuuccacagauagcgaccagaccucucucuacgugcaggccuccggcagagucacggugagcacaaaacggucccagcaaaccgugaucccgaauauugggucucgccccugggucagaggaaucagcucccggauuagcaucuauuggacaauuguuaagccuggcgacauccugcugaucaacucuaccgggaaccucauugcuccccgcggauacuucaagaucagaaauggcaaauccagcauuaugcggucugaugccccuaucgacaacuguaauagcgagugcauuacccccaacggcuccaucccgaaugauaagccuuuucagaacgugaaucgcaucacauauggggcuugucccagauacgugaaacagaacacgcugaagcuggccaccggaaugcggaaugucccugaaaaacagacacgcggcauuuucggggcgaucgccggauuuauugagaacggcugggaagggaugaucgacggaugguauggcuucagacaccaaaauucugagggcaccgggcaggcugccgaucuuaagagcacacaggcugccauugaccaaaucaacggaaaacucaaucggcugaucgagaagaccaacgaaaaguuucaucagauugagaaagaguucuccgaaguggaaggcagaauccaggaucuugagaaguacguugaggacacgaaaauugaucuguggagcuauaaugccgaacuccugguggcucuggagaaccagcacacaaucgaccucaccgauucugaaaugaacaagcuguucgagcgcacccggaaacaacuuagagaaaaugcggaggacauggggaacggaugcuuuaagauuuaccauaagugugacaaugccugcaucggcuccauucgcaacgggacauacgaucacgacgucuaucgggaugaggcucugaauaacagauuccagaucaaaggcguggaacucaagagcggauacaaagacuggauccuguggauuucuuuugccaucuccugcuuccuucuguguguugugcuccugggcuuuauuaugugggccugccagaaggggaauauccgcuguaacauuugcaucuga

SEQ ID NO: 183924 - RNA, 1701 nt, Artificial Sequence
  derived and/or modified sequence opt5 from hemagglutinin__InfluenzaA__ABE14840
augaagaccaucauugcccugagcuacauccucugccugguguucgcucagaaacuucccagaaacgacaauuccacagccacgcugugucucggccaccaugcggucccuaacgggacccugguuaagacaauuaccaaugaucaaaucgaggugacaaacgcuaccgaacuugugcagucuagcuccacaggacggauuugcgacucuccgcaccgcauccuggauggcaaaaauuguacccucaucgacgcccugcugggggauccccauugcgacggauuucagaacaaggagugggaucucuucgucgaaagaagcaaagccuauuccaauuguuacccuuaugacgugcccgauuacgcuucucugcggagccuuguugccuccagcggcacgcuggaguuuaccaacgaaggguucaauuggacaggaguggcucaggacggcaagucuuaugccugcaagcgcggcuccgucaacagcuuuuucucuagacucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccgggcgggucacggugagcacaaaacgcucccagcagaccgugaucccgaauauuggcucuagacccuggguccgggggaucagcucccgcauuagcaucuauuggacaauuguuaagccuggagacauccugcucaucucuuccaccggcaaccugauugcucccagaggguacuucaagauccggaacggaaaaagcucuauuaugcgcagcgaugccccuaucgacaauuguaacuccgagugcauuacccccaauggcucuaucccgaacgauaagccuuuucaaaaugugaacagaaucacauauggcgcuuguccccgguacgugaaacagaauacgcuuaagcuggccaccgggaugcgcaacgucccugaaaaacagacaagaggaauuuucggcgcgaucgccggguuuauugagaauggaugggaaggcaugguggacgggugguauggauuccggcaccagaacagcgagggcaccggccaagcugccgaucucaaguccacacaggcugccaucgaccagauuaaugggaaacugaacagacuuaucgagaagaccaaugaaaaguuucaucaaaucgagaaagaguucagcgaaguugaaggacgcauucaggaucuggagaaguacguggaggacacgaaaaucgaucucuggucuuauaacgccgaacugcuggucgcucucgagaaucagcacacaauugaccugaccgauuccgaaaugaacaaacuuuucgagcggaccagaaagcagcugcgcgaaaacgcggaggacaugggcaaugggugcuuuaagaucuaccauaagugugacaacgccugcauuggaagcauccggaauggcacauacgaucacgacguguauagagaugaggcucucaacaaucgcuuccaaauuaaagggguugaacugaagucuggcuacaaagacuggauccuuuggaucuccuuugccauuagcugcuuccugcucugugugguccugcugggauuuaucaugugggccugccagaagggcaacauucgguguuccaucugcauuuga

SEQ ID NO: 183925 - RNA, 1701 nt, Artificial Sequence
  derived and/or modified sequence opt5 from hemagglutinin__InfluenzaA__ABE15578
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaacagcuuuuucucucgccucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccggcagagucacggugagcacaaaacggucccagcagaccgugaucccgaauauugggucucgccccugggucagaggaaucagcucccggauuagcaucuauuggacaauuguuaagccuggcgacauccugcucaucaacucuaccgggaaccugauugcuccccgcggauacuucaagaucagaaauggcaaauccagcauuaugcggucugaugccccuaucgacaacuguaauagcgagugcauuacccccaacggcuccaucccgaaugauaagccuuuucaaaacgugaaucgcaucacauauggggcuugucccagauacgugaaacagaacacgcuuaagcuggccaccggaaugcggaaugucccugaaaaacagacacgcggcauuuucggggcgaucgccggauuuauugagaacggcugggaagggaugguggacggaugguauggcuucagacaccaaaauucugagggcaccgggcaggcugccgaucucaagagcacacaggcugccaucgaccagauuaacggaaaacugaaucggcuuaucgagaagaccaacgaaaaguuucaucaaaucgagaaagaguucuccgaaguugaaggccgcauucaggaucuggagaaguacguggaggacacgaaaaucgaucucuggagcuauaaugccgaacugcuggucgcucucgagaaccagcacacaauugaccugaccgauucugaaaugaacaagcuguucgagagaacccggaaacagcugagagaaaaugcggaggacauggggaacggaugcuuuaagaucuaccauaagugugacaaugccugcauuggcuccauccgcaacgggacauacgaucacgacguguaucgggaugaggcucucaauaacagauuccaaauuaaaggcguugaacuuaagagcggauacaaagacuggauccuuuggaucucuuuugccauuuccugcuuccugcucugugugguccugcugggcuuuaucaugugggccugccagaaggggaauauucgcuguagcaucugcauuuga

SEQ ID NO: 183926 - RNA, 1701 nt, Artificial Sequence
  derived and/or modified sequence opt5 from hemagglutinin__InfluenzaA__ABE26991
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgacugugaugccaagugccagaccccucaaggcgcuauuaauucuagccugcccuuucagaacgugcacccggugaccaucggggaguguccuaaauacguccgguccacaaagcuccgcauggugacgggacugagaaauauccccucuauucagagccggggccuuuucggggccaucgcuggauuuauugaaggcggguggaccggaaugaucgacggcugguauggcuaccaucaccagaacgagcaaggguccggauacgccgccgauaaaaagagcacacagaaugcuauugacggcaucaccaacaaaguuaauucugugaucgaaaagaugaacacacaguucaccgcggucgggaaggaguucaauaaacuggagcgcagaauggaaaaccucaauaagaaaguggaugacggauuucuggacauuuggacguauaacgccgagcugcucguucugcuugaaaacgagcggacacuggauuuccacgacuccaaugugaagaaccucuacgaaaaagucaagaaucagcugaagaacaaugcuaaagagaucggcaacgggugcuuugaguucuaucauaaguguaauaacgaaugcauggagagcgugaaaaauggcaccuacgauuauccuaaguacucugaagaguccacccuuaaacgcgagaagauugacggagucaagcuggaaagcaugggcguguaucaaauccucgccauuuacuccacaguugccucuagccuggugcugcucgucucccugggggcuaucucuuuuuggaugugcagcaacggaucccuucaguguagaaucugcauuuga

SEQ ID NO: 183927 - RNA, 1701 nt, Artificial Sequence
  derived and/or modified sequence opt5 from hemagglutinin__InfluenzaA__ABF47550
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuaugcuugcaagcgggggagcgucaacucuuucuuuucccgccugaauuggcuccacgagagcgaguacaaguauccugcccugaacgugaccaugcccaauaacggaaaauucgauaaacuuuacaucuggggcguucaucacccuucuacagacagagaacaaaccaaucuguacgugcgggcguccgggcgcgucacggugagcacaaagagaucccagcagaccgugauuccgaacaucggaucucggcccuggguccgcggccucagcuccagaauuagcaucuauuggacaauuguuaagccuggggauauccugcugaucaacucuaccggaaaucucauugcuccccggggcuacuuuaaaauccgcaccggcaaguccagcauuaugagaucugacgccccuaucgggacauguagcuccgagugcauuacgcccaacggaucuaucccgaaugacaagccuuuccagaacgugaauaaaaucaccuauggcgccuguccccgguacgugaagcaaaacacacugaaacuugcuaccgggaugcgcaaugucccugaaaagcagacaagaggaauuuuuggcgccaucgcgggguucauugagaacggaugggagggcaugguggauggcugguauggguuucggcaccagaauagcgaaggaaccggccaggccgcugaccugaaauccacgcaagccgcuaucgaucagauuaacgggaagcucaauagacugaucgagaaaacaaacgaaaaguuccaucagaucgagaaggaguucagcgaaguugagggacgcauucaagaccuugaaaaauacguggaggauaccaagaucgaccuguggucuuauaaugccgaacuccuggucgcccuggagaaccagcacaccauugaucucacagacuccgaaaugaauaaacuguuugagaagacccggaaacagcuuagagagaacgcugaagauaugggcaacgggugcuucaagaucuaccauaagugugacaaugcgugcauuggcagcauccgcaacggaacauacgaucacgacguguaucgggacgaggcccugaauaacagauuucagauuaaaggcguugaacucaagucuggguacaaagauuggauccuguggaucuccuucgcuauuagcugcuuucuucugugugugguccuccugggauucaucaugugggccugccaaaagggcaauauucgcuguaacaucugcauuuga

SEQ ID NO: 183928 - RNA, 1698 nt, Artificial Sequence
  derived and/or modified sequence opt5 from hemagglutinin__InfluenzaA__ABF47561
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaagcugucuauguccuacguuaauaacaaagagaaggaagugcugguccucuggggcgugcaucacccuccgaauaucggggaucagagagcccuguaccacacagagaacgcuuaugugagcgucguuuccucucauuacagccggcgcuucacccccgaaauugccaaaagaccuaaggugcgggaccaggagggacgcaucaacuauuacuggacgcuucuggaacccggcgauacaauuaucuuugaggcgaaugggaaccucauugccccuugguaugcuuucgcccuguccagaggauuuggcagcggcaucauuaccucuaaugcucccaugggggagugugacgccaagugccagacaccgcaaggagcgaucaacuccagccuuccuuuccagaaugugcaccccgucaccaucggcgaauguccuaaauacgugcggucugccaagcugcgcaugguuaccgggcucagaaacauucccagcauccagucccggggacuguuuggcgcuauugccggguucaucgagggaggcuggacaggcaugguggaugggugguauggauaccaucaccagaaugaacaaggcucuggguacgcugccgaccagaaaagcacgcagaacgccauuaauggaaucaccaacaaggucaauuccgugaucgagaaaaugaacacacaguuuaccgcuguuggcaaggaguucaauaaacuggaacgcagaauggagaaccucaauaagaagguggaugacggguuccuggauauuuggacauauaacgcggaacuucugguccuccuggagaacgaacggacccuugacuuucacgacagcaaugugaaaaaccuguacgagaaggucaaaucucaacucaagaauaacgccaaagaaaucggcaauggaugcuucgaguuuuaucauaaguguaacaaugagugcauggaauccgugaagaacggcacguacgauuaucccaaauacagcgaggaaucuaagcugaaucgcgagaaaauugacgggguuaagcuggaguccaugggaguguaucagauccucgcuauuuacagcacagucgccuccucucuggugcuucugguuagccucggcgccaucuccuucuggaugugcucuaacgggagccugcaguguagaaucugcauuuga

SEQ ID NO: 183929 - RNA, 1698 nt, Artificial Sequence
  derived and/or modified sequence opt5 from hemagglutinin__InfluenzaA__ABF47572
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggauaaagaggugcugguccucuggggcgugcaucacccuccgaacaucggggaccagagagcccuguaccacacagaaaacgcuuaugugagcgucguuuccucucauuacagccggcgcuucacccccgagauugccaagagaccuaaagugcgggaucaggaaggacgcaucaauuauuacuggacgcuucuggagcccggcgacacaauuaucuuugaagcgaacgggaaucucauugccccuugguaugcuuucgcccuguccagaggauuuggcagcggcaucauuaccucuaacgcucccaugggggagugugaugccaagugccagacaccgcaaggagcgaucaauuccagccuuccuuuccagaacgugcaccccgucaccaucggcgaguguccuaaguacgugcggucugccaaacugcgcaugguuaccgggcucagaaauauucccagcauccagucccggggacuguuuggcgcuauugccggguucaucgaaggaggcuggacaggcaugguggacgggugguauggauaccaucaccagaacgagcaaggcucuggguacgcugccgaucaaaagagcacgcagaaugccauuaacggaaucaccaauaaagucaacuccgugaucgaaaagaugaauacacaguuuaccgcuguuggcaaagaguucaacaagcuggaacgcagaauggagaaucucaacaaaaagguggacgauggguuccuggacauuuggacauauaacgcggagcuucugguccuccuggaaaaugagcggacccuugacuuucacgauagcaacgugaagaaucuguacgaaaaagucaagucucagcucaaaaacaaugccaaggagaucggcaacggaugcuucgaauuuuaucauaaauguaauaacgagugcauggaguccgugaagaauggcacguacgacuaucccaaguacagcgaagagucuaaacugaaccgcgaaaagauugaugggguuaaacuggaguccaugggaguguaucagauccucgcuauuuacagcacagucgccuccucucuggugcuucugguuagccucggcgccaucuccuucuggaugugcucuaaugggagccugcaguguagaaucugcauuuga

SEQ ID NO: 183930 - RNA, 1698 nt, Artificial Sequence; identical to SEQ ID NO: 183824
  derived and/or modified sequence opt5 from hemagglutinin__InfluenzaA__ABF47583

SEQ ID NO: 183931 - RNA, 1701 nt, Artificial Sequence
  derived and/or modified sequence opt5 from hemagglutinin__InfluenzaA__ABF47594
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaacaaugaaucuuucaacuggaccggaguggcucagaauggcacauccuaugccugcaagcggcgcagcgucaagucuuucuucuccagacucaacuggcugcacaaacuugaguacaaguauccugcgcaaaaugugaccaugcccaacaaugacaaauuugauaagcuguacauuuggggcguucaucacccuagcacagacucugaucagaccucccucuacgugcaggccagcgggcgggucacgguguccacaaaacgcucucagcaaaccgugaucccgaacauuggaagcagacccuggguccggggcguuuccagccgcaucucuauuuauuggacaaucgugaagccuggggacauucugcugaucaacuccaccggaaaucucaucgcucccagaggcuacuucaagauucggagcgggaaaucuagcaucaugcgcuccgacgccccuauuggaaacuguaauucugagugcaucacccccaacggcagcauuccgaaugauaagccuuuucagaacgugaauagaaucacauauggcgcuuguccccgguacgucaaacagaacacgcugaagcuggccaccgggaugcgcaaugugccugaaaaacagacaagaggaaucuucggcgcgauugccggguuuaucgagaacggaugggaaggcaugguugacgggugguauggauuccggcaccaaaauuccgagggcaccggccaggcugccgaucuuaagagcacacaggcugccauuaaccaaaucaaugggaaacucaacagacugauugagaagaccaaugaaaaguuucaucagaucgagaaagaauuuucugagguggaaggacgcauccaggaccuugagaaguacgucgaggauacgaaaauugaccugugguccuauaacgccgaacuccugguggcucuggagaaccagcacacaaucgaucucaccgacagcgaaaugaauaagcuguucgagcggaccagaaaacaacuucgcgaaaacgcggaggauaugggcaaugggugcuuuaagauuuaccauaagugugacaacgccugcaucggaucuauucggaauggcacauacgaucacgacguuuauagagacgaggcucugaacaaucgcuuccagaucaaagggguggaacucaaguccggcuacaaagauuggauucuguggaucagcuuugccaucuccugcuuccuucugugugucgugcuccugggauuuauuaugugggccugccagaagggcaacauccgguguaauauuugcaucuga

SEQ ID NO: 183932 - RNA, 1701 nt, Artificial Sequence
  derived and/or modified sequence opt5 from hemagglutinin__InfluenzaA__ABF47605
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuagcggaaaccugaucgcccccugguaugcuuuugcccuuucuagaggcuucggguccggaauuaucacaagcaaugcgucuaugggcgagugugacgccaagugccagaccccucaaggcgcuauuaacagcucccugcccuuucagaaugugcacccggugaccaucggggaauguccuaaauacguccggucuacaaagcuccgcauggugacgggacugagaaacauccccagcauucagucccggggccuuuucggggccaucgcuggauuuauugagggcggguggaccggaaugaucgauggcugguauggcuaccaucaccagaaugaacaagggagcggauacgccgccgacaaaaagucuacacagaacgcuauugauggcaucaccaauaaaguuaacuccgugaucgagaagaugaauacacaguucaccgcggucgggaaggaguucaacaaacuggaacgcagaauugagaaucucaacaagaaaguggacgauggauuucuggacaucuggacguauaaugccgaacugcucguucugcuugagaacgaacggacacuggacuuccacgauagcaacgugaagaaucucuacgagaaagucaagaaccagcugaagaauaacgcuaaagagauuggcaaugggugcuuugaguucuaucauaaguguaacaaugaaugcauggaaucugugaaaaacggcaccuacgacuauccuaaguacuccgaggagagcaaacuuaagcgcgaaaagaucgauggagucaaacuggaguccaugggcguguaucaaauucucgccaucuacucuaccguugccagcucccuggugcugcucgucucucugggggcuaucagcuuuuggaugugcuccaauggaagccuucaguguagaauuugcaucuga

SEQ ID NO: 183933 - RNA, 1701 nt, Artificial Sequence; identical to SEQ ID NO: 183917
  derived and/or modified sequence opt5 from hemagglutinin__InfluenzaA__ABF47616

SEQ ID NO: 183934 - RNA, 1701 nt, Artificial Sequence
  derived and/or modified sequence opt5 from hemagglutinin__InfluenzaA__ABF47627
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgacugugaugccaagugccagaccccucaaggcgcuauuaauucuagccugcccuuucagaacgugcacccggugaccaucggggaguguccuaaauacguccgguccacaaagcuccgcauggugacgggacugagaaauauccccucuauucagagccggggccuuuucggggccaucgcuggauuuauugaaggcggguggaccggaaugaucgacggcugguauggcuaccaucaccagaacgagcaaggguccggauacgccgccgauaaaaagagcacacagaaugcuauugacggcaucaccaacaaaguuaauucugugaucgaaaagaugaacacacaguucaccgcggucgggaaggaguucaauaaacuggagcgcagaauggaaaaccucaauaagaaaguggaugacggauuucuggacauuuggacguauaacgccgagcugcucguucugcuugaaaacgagcggacacuggauuuccacgacuccaaugugaagaaccucuacgaaaaagucaagaaucagcugaagaacaaugcuaaagagaucggcaacgggugcuuugaguucuaucauaaguguaauaacgaaugcauggagagcgugaaaaauggcaccuacgauuauccuaaguacucugaagaguccaaacuuaagcgcgagaagauugacggagucaaacuggaaagcaugggcguguaucaaauccucgccauuuacuccaccguugccucuagccuggugcugcucgucucccugggggcuaucucuuuuuggaugugcagcaacggaucccuucaguguagaaucugcauuuga

SEQ ID NO: 183935 - RNA, 1701 nt, Artificial Sequence
  derived and/or modified sequence opt5 from hemagglutinin__InfluenzaA__ABF47638
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccaaucugucuaaguccuacgugaacaauaaagagaaggaaguucucgugcuguggggaguccaucacccuagcaacauuggggaucagagagccaucuaccacaccgagaacgcguauguguccguggucucuagccauuacucccggcgcuuuacgccggaaaucacaaagagacccaaaguucgggaccaggagggccgcauuaauuauuacuggacccugcucgagccuggggauacaaucauuuucgaagccaacggaaaucugaucgcucccugguaugccuuugcucuuagcagaggcuucgggucuggaauuaucaccuccaacgccagcaugggcgagugugacgcgaagugccagaccccucaaggcgccauuaauucuagccugcccuuucagaacgugcacccggugacaaucggggaauguccuaaauacguccgguccacgaagcuccgcauggugaccggacugagaaauauccccucuauucagagccggggccuuuucggggcuaucgccggauuuauugagggcggguggacaggaaugaucgauggcugguauggcuaccaucaccagaacgaacaaggguccggauacgcugccgaccagaaaagcacccagaaugccauugauggcaucacaaacaagguuaauucugugaucgagaaaaugaacacccaguucacggcugucgggaaggaguucaauaagcuggaacgcagaauggagaaccucaauaaaaagguggacgauggauuucuggacauuuggacauauaacgcggaacugcucguucugcuugagaacgaacggacccuggacuuccacgauuccaaugugaaaaaccucuacgagaaggucaaaacccaacugaagaauaacgccaaggagaucggcaaugggugcuuugaguucuaucauaaauguaacaaugaaugcauggaaagcgugaagaacggcacauacgacuauccuaaauacucugaggaguccaaacuuaaucgcgagaaaauugauggagucaagcuggaaagcaugggcguguaucagauccucgcuauuuacuccaccguugccucuagccuggugcugcucgucucccugggggccaucucuuuuuggaugugcagcaacggaucccuucaguguagaaucugcauuuga

SEQ ID NO: 183936 - RNA, 1701 nt, Artificial Sequence; identical to SEQ ID NO: 183935
  derived and/or modified sequence opt5 from hemagglutinin__InfluenzaA__ABF47649

SEQ ID NO: 183937 - RNA, 1701 nt, Artificial Sequence
  derived and/or modified sequence opt5 from hemagglutinin__InfluenzaA__ABF47660
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcugugggggauucaucacccuagcaacaucggagaucagagagccaucuaccacaccgagaacgcguaugucuccguggugucuagccauuacucccggcgcuuuacgccggaaauugccaagagacccaaaguccgggaccaggagggccgcaucaauuauuacuggacacugcucgagccuggggauaccauuaucuucgaagcuaacggaaaucugauugcccccugguaugcuuuugcccuuagcagaggcuucgggucuggaaucauuacauccaacgcgagcaugggcgacugugaugccaagugccagaccccucaaggcgcuaucaauucuagccugcccuuucagaacguucacccggugaccaucggggaguguccuaaauacgugcgguccacaaagcuccgcauggucacgggacugagaaauauucccucuauccagagccggggccuuuucggggccauugcuggauuuaucgaaggcggguggaccggaaugauugacggcugguauggcuaccaucaccagaacgagcaaggguccggauacgccgccgauaaaaagagcacacagaaugcuaucgacggcaucaccaacaaaguuaauucugugauugaaaagaugaacacacaguucaccgcgguggggaaggaguucaauaaacuggagcgcagaauggaaaaccucaauaagaaagucgaugacggauuucuggacaucuggacguauaacgccgagcugcucgugcugcuugaaaacgagcggacacuggauuuccacgacuccaauguuaagaaccucuacgaaaaagugaagacccagcugaagaauaacgcuaaagagauuggcaaugggugcuuugaguucuaucauaaguguaacaaugaaugcauggagagcgucaaaaacggcaccuacgauuauccuaaguacucugaagaguccaaacuuaagcgcgagaagaucgacggagugaaacuggaaagcaugggcgucuaucaaauucucgccaucuacuccacaguggccucuagccugguucugcucgugucccugggggcuaucucuuuuuggaugugcagcaauggaucccuucaguguagaauuugcaucuga

SEQ ID NO: 183938 - RNA, 1698 nt, Artificial Sequence
  derived and/or modified sequence opt5 from hemagglutinin__InfluenzaA__ABF47671
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuucgugagcgucguuuccucucauuauagccggcgcuuuacccccgaaauugccaagagaccuaaagugcgggaccaggagggacgcaucaauuacuauuggacgcuucuggaacccggcgauacaauuaucuucgaggcgaacgggaaucucauugccccuugguacgcuuuugcccuguccagaggauucggcagcggcaucauuaccucuaacgcucccauggacgagugugaugccaagugccagacaccgcaaggggcgaucaauuccagccuuccuuuucagaacgugcaccccgucaccaucggagaauguccuaaguaugugcggucugccaaacugcgcaugguuaccggccucagaaauauucccagcauccagucccgggggcuguucggagcuauugccggcuuuaucgaagggggauggacaggcaugguggacggcugguacggguaucaucaccagaacgaacaaggaucuggcuacgcugccgaucaaaagagcacgcagaaugccauuaacgggaucaccaauaaagucaacuccgugaucgagaagaugaauacacaguucaccgcuguuggaaaagaguucaacaagcuggagcgcagaauggagaaucucaacaaaaagguggacgauggcuuucuggacauuuggacauacaacgcggaacuucugguccuccuggagaaugaacggacccuugacuuccacgauagcaacgugaagaaucuguaugagaaagucaagucucagcucaaaaacaaugccaaggaaaucgggaacggcugcuuugaguucuaccauaaauguaauaacgagugcauggaauccgugaagaauggaacguaugacuaccccaaguauagcgaggaaucuaaacugaaccgcgagaagauugauggcguuaaacuggaguccauggggguguaccagauccucgcuauuuauagcacagucgccuccucucuggugcuucugguuagccucggagccaucuccuuuuggaugugcucuaauggcagccugcaguguagaaucugcauuuga

SEQ ID NO: 183939 - RNA, 1701 nt, Artificial Sequence
  derived and/or modified sequence opt5 from hemagglutinin__InfluenzaA__ABF47693
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgccccgcugcagcugggcaaauguaauauugccggguggauccucggaaacccugagugcgaaucccuguucucuaaaaagagcugguccuauauugcugagacccccaauucugaaaacggcacauguuaccccggguauuuugccgauuacgaggagcuucgggaacaacugagcuccgugagcucuuucgagcgcuuugaaaucuucccuaaggagagauccuggcccaagcauaauguuacccggggagugacggcuagcugcucucacaaaggcaaguccagcuuuuaucgcaaccuccuguggcuuaccgagaaaaauggcucuuacccuaaccuguccaagagcuaugucaauaacaaggaaaaagaggugcucguucuguggggagugcaucaccccuccaauaucgaagaccagaagacaauuuacagaaaagagaacgccuacgucucuguggugagcuccaacuauaaucggcgcuucaccccugaaaucgcggagagaccgaagguccgggggcaggccggccgcauuaacuacuauuggacacugcucgagcccggggauaccaucauuuuugaagcuaauggaaaccugaucgccccuuggcacgcuuucgcccuuaauagaggcuuugggagcggaauuaucacgucuaacgcguccauggacgagugugauacaaaaugccagacaccccaaggcgccaucaauagcucucugccuuuccagaacauucaucccguuaccaucggcgaauguccgaaguacgugcggagcaccaaacuccgcauggugaccgggcugagaaauauuccuuccauccagucucggggacuuuuuggcgcuauugccggguucaucgagggaggcuggacagggaugaucgacggaugguauggcuaccaccaucagaacgaacaaggcagcggguaugcugccgaucagaaguccacgcagaaugccauuaacggaaucaccaauaaggucaacagcgugauugagaaaaugaauacacaguuuaccgcuguuggcaaggaguucaacaaacuggaaaagcgcauggagaaccucaauaaaaagguggacgauggguuccuggacaucuggacauacaacgcggaacugcucguccugcuugagaaugaaagaacccuggacuuucacgauucuaacgugaagaaucucuacgagaaaguuaagucccaacugaaaaacaaugccaaggagauuggaaacggcugcuucgaauuuuaucacaaauguaauaacgagugcauggaaagcgugaagaaugggacguacgacuaucccaaguacucugaggaguccaaacuuaaccgggaaaagaucgauggcgucaaacuggagagcaugggaguguaucagauccucgcuauuuacuccacagucgccucuagccuggugcugcucguuucccugggcgccaucucuuucuggaugugcagcaaugggucccuucaguguagaauuugcaucuga

SEQ ID NO: 183940 - RNA, 1701 nt, Artificial Sequence; identical to SEQ ID NO: 183939
  derived and/or modified sequence opt5 from hemagglutinin__InfluenzaA__ABF47704

SEQ ID NO: 183941 - RNA, 1701 nt, Artificial Sequence
  derived and/or modified sequence opt5 from hemagglutinin__InfluenzaA__ABF47715
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucgcggagagaccgaagguccgggggcaggccggccgcauuaauuacuauuggacacugcucgagcccggggauaccaucauuuuugaagcuaacggaaaucugaucgccccuuggcacgcuuucgcccuuaacagaggcuuugggucuggaauuaucacguccaaugcgagcauggacgagugugauacaaaaugccagacaccccaaggcgccaucaacucuagccugccuuuccagaauauucaucccguuaccaucggcgaauguccgaaguacgugcgguccaccaaacuccgcauggugaccgggcugagaaacauuccuucuauccagagccggggacuuuuuggcgcuauugccggguucaucgagggaggcuggacagggaugaucgacggaugguauggcuaccaccaucagaaugaacaaggcuccggguaugcugccgaucaaaagagcacgcagaacgccauuaauggaaucaccaacaaggucaauucugugauugagaaaaugaacacacaguuuaccgcuguuggcaaggaguucaauaaacuggaaaagcgcauggagaaccucaacaaaaagguggacgauggguuccuggacaucuggacauacaaugcggaacugcucguccugcuugagaacgaaagaacccuggacuuucacgauuccaaugugaagaaccucuacgagaaaguuaagagccagcugaaaaauaacgccaaggagauuggaaauggcugcuucgaauuuuaucacaaauguaacaaugagugcauggaaucugugaagaacgggacguacgacuaucccaaguacuccgaggagagcaaacuuaaucgggaaaagaucgauggcgucaaacuggaguccaugggaguguaucagauccucgcuauuuacucuacagucgccagcucccuggugcugcucguuucucugggcgccaucagcuucuggaugugcuccaacgggagccuucaguguagaauuugcaucuga

SEQ ID NO: 183942 - RNA, 1701 nt, Artificial Sequence; identical to SEQ ID NO: 183939
  derived and/or modified sequence opt5 from hemagglutinin__InfluenzaA__ABF47726

SEQ ID NO: 183943 - RNA, 1701 nt, Artificial Sequence; identical to SEQ ID NO: 183939
  derived and/or modified sequence opt5 from hemagglutinin__InfluenzaA__ABF47737

SEQ ID NO: 183944 - RNA, 1701 nt, Artificial Sequence
  derived and/or modified sequence opt5 from hemagglutinin__InfluenzaA__ABF47748
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaagucuuccuuuuaucggaaucuccuguggcuuaccgagaaaaacggcagcuacccuaaucuguccaagucuuaugucaacaauaaggaaaaagaggugcucguucuguggggagugcaucaccccagcaacaucgaagaccagaagacaauuuaccgcaaagagaaugccuacgucuccguggugagcucucacuauaacagacgguucaccccugaaaucgcgaagcgcccgaaagucagagaucaggaggggcggauuaacuacuauuggacacugcucgagcccggcgacaccaucauuuuugaagccaaugggaaccugaucgcuccuugguacgccuucgcucuuucccgcggauuuggcagcgggauuaucacgucuaaugccagcauggaugagugugacgcgaagugccagacaccccaaggagccaucaacuccucucugccuuuccagaauguucaucccgugaccauuggcgaauguccgaaauaugugagaagcacaaagcuccggauggucaccggccugcgcaacaucccuuccauucagagcagagggcuuuuuggagcuaucgccggcuucauugaagggggauggaccggcaugaucgaugggugguacggauaucaccaucagaaugaacaaggcucuggcuacgcugccgaccagaaguccacacagaacgccaucaaugggauuacgaacaaagugaauagcguuaucgagaagaugaacacccaguuuacagcugugggaaaagaguucaauaagcuggaaaaacggauggagaaccucaauaagaaggucgaugacggcuuccuggacauuuggaccuacaacgcggaacugcucgugcugcuugagaacgaacgcacacuggauuuucacgacucuaauguuaaaaaccucuaugagaaggugaaaucccaacugaagaauaacgccaaagagaucgggaauggaugcuucgaauuuuaccacaaguguaacaaugagugcauggaaagcgucaagaacggcaccuaugauuaccccaaauauuccgaggagucuaaacuuaauagagagaagauugacggggugaagcuggagagcaugggcgucuaccagauccucgcuaucuauuccacgguggccucuagccugguucugcucgugucccugggagccauuagcuucuggaugugcucuaacggcucccuucagugucggaucugcauuuga

SEQ ID NO: 183945 - RNA, 1701 nt, Artificial Sequence
  derived and/or modified sequence opt5 from hemagglutinin__InfluenzaA__ABF47770
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaacauaauguuaccaagggagugacggcuucuugcucccacaaaggcaagagcucuuuuuaucgcaaccuccuguggcuuaccgagaagaauggcuccuacccuaaccugagcaaauccuaugucaauaacaaggaaaaagaggugcucguucuguggggagugcaucaccccucuaauaucgaagaccagaagacaauuuacagaaaagagaacgccuacgucagcgugguguccagccacuauaaccggcgcuucaccccugaaaucgcgaagagaccgaaaguccggaaucaggaggggcgcauuaacuacuauuggacacugcucgagcccggcgauaccaucauuuuugaagccaaugggaaccugaucgcuccuugguacgccuucgcucuuucuagaggauuuggcuccgggauuaucacgagcaaugccucuauggacgagugugaugcgaagugccagacaccccaaggagccaucaacagcucccugccuuuccagaauguucaucccgugaccauuggcgaauguccgaaguaugugcggucuacaaaacuccgcauggucaccggccugagaaacaucccuagcauucagucccgggggcuuuuuggagcuaucgccggcuucauugaagggggauggaccggcaugaucgacgggugguacggauaucaccaucagaaugaacaaggcagcggcuacgcugccgaucagaagucuacacagaacgccaucaaugggauuacgaacaaaguuaauuccaucauugagaagaugaacacccaguuuacagcugugggaaaagaguucaauaagcuggaaaagcgcauggagaaccucaacaaaaagguggacgauggcuuccuggacaucuggaccuacaaugcggaacugcucguccugcuugagaacgaaagaacacuggacuuucacgauagcaaugugaaaaaccucuaugagaagguuaaaucucaacugaagaauaacgccaaggagauugggaauggaugcuucgaauuuuaccacaaauguaacaaugagugcauggaauccgugaagaacggcaccuaugacuaccccaaauauagcgaggaguccaaacuuaaucgggagaagaucgauggggucaagcuggagucuaugggcguguaccagauccucgcuauuuauagcacggucgccuccucucuggugcugcucguuagccugggagccaucuccuucuggaugugcagcaacggcucucuucagugucgcauuugcaucuga

SEQ ID NO: 183946 - RNA, 1701 nt, Artificial Sequence; identical to SEQ ID NO: 183945
  derived and/or modified sequence opt5 from hemagglutinin__InfluenzaA__ABF47781

SEQ ID NO: 183947 - RNA, 1701 nt, Artificial Sequence; identical to SEQ ID NO: 183945
  derived and/or modified sequence opt5 from hemagglutinin__InfluenzaA__ABF47792

SEQ ID NO: 183948 - RNA, 1701 nt, Artificial Sequence; identical to SEQ ID NO: 183945
  derived and/or modified sequence opt5 from hemagglutinin__InfluenzaA__ABF47803

SEQ ID NO: 183949 - RNA, 1701 nt, Artificial Sequence; identical to SEQ ID NO: 183945
  derived and/or modified sequence opt5 from hemagglutinin__InfluenzaA__ABF47814

SEQ ID NO: 183950 - RNA, 1701 nt, Artificial Sequence; identical to SEQ ID NO: 183945
  derived and/or modified sequence opt5 from hemagglutinin__InfluenzaA__ABF47825

SEQ ID NO: 183951 - RNA, 1701 nt, Artificial Sequence; identical to SEQ ID NO: 183945
  derived and/or modified sequence opt5 from hemagglutinin__InfluenzaA__ABF47836

SEQ ID NO: 183952 - RNA, 1701 nt, Artificial Sequence; identical to SEQ ID NO: 183945
  derived and/or modified sequence opt5 from hemagglutinin__InfluenzaA__ABF47847

SEQ ID NO: 183953 - RNA, 1701 nt, Artificial Sequence
  derived and/or modified sequence opt5 from hemagglutinin__InfluenzaA__ABF47858
augaagaccaucauugcccugagcuacauccucugccugguguucgcucagaaacuucccggcaacgacaaugggacagccacgcugugucucggacaccaugcggucccuaacggcacccugguuaagacaauuaccaaugaucaaaucgaggugacaaacgcuaccgaacuugugcaguccucuagcacagggagaauuugcgacuccccgcaccggauccuggauggcaaaaauuguacccucaucgacgcccugcugggagauccccauugcgacggguuucagaacaaggagugggaucucuucgucgaacgcucuaaagccuauagcaauuguuacccuuaugacgugcccgauuacgcuucccugagaucucuuguugccagcuccggaacgcuggaguuuauuaacgaagacuucaauuggaccggcguggcucaggauggcaagagcuaugccugcaagcgggggucugucaacuccuuuuucagccgccucaauuggcugcacaaacuugaguacaaguauccugcgcugaacgugacaaugcccaauaacggaaaauuugacaagcucuacaucuggggcguucaucacccuucuaccgauuccgaccaaacaagccuguacgugagagccucugggcgggucaccguguccacgaaacgcagccagcagacagugauuccgaauaucggauucagacccuggguccggggccuguccucucgcauuagcaucuauuggaccauuguuaagccuggggacauccuccugaucaacuccacaggaaaccuuauugcucccagaggcuacuuuaagauccggaauggcaaaagcucuauuaugcgcuccgaugccccuaucgggaacuguagcucugagugcauuacccccaauggaagcaucccgaacgacaagccuuuccagaaugugaacagaaucaccuauggcgcuuguccccgguacgugaaacaaaauacacugaagcucgccacggggaugcgcaacgucccugaaaaacagaccagaggaauuuuuggcgcgaucgccggguucauugagaauggaugggaaggcaugguggauggcugguauggguuucggcaccagaacuccgagggaacaggccaggcugccgaccugaagucuacccaagcugccaucgaucagauuaaugggaaacuuaacagacugaucgagaagacaaaugaaaaguuccaucagaucgagaaagaguucagcgaaguugaaggacgcauucaagaccucgagaaguacguggaggauaccaaaaucgaccugugguccuauaacgccggccugcucgucgcucuggaaaaucagcacacgauugaucuuacagacagcgagaugaacaagcuguuugaacggaccagaaaacagcuccgcgagaacgcggaagauauggggaauggcugcuucaagaucuaccauaagugugacaacgccugcauuggaucuauccggaauggcaccuacgaccacgauguguauagagacgaggcucugaacaaucgcuuucagauuaaagggguugagcuuaaguccggauacaaagauuggauccuguggaucagcuucgccauuucuugcuuucuccugugugugguccugcucggcuucaucaugugggccugccaaaaggggaacauucgguguaauaucugcauuuga

SEQ ID NO: 183954 - RNA, 1698 nt, Artificial Sequence; identical to SEQ ID NO: 183766
  derived and/or modified sequence opt5 from hemagglutinin__InfluenzaA__ABF47869

SEQ ID NO: 183955 - RNA, 1698 nt, Artificial Sequence; identical to SEQ ID NO: 183766
  derived and/or modified sequence opt5 from hemagglutinin__InfluenzaA__ABF47880

SEQ ID NO: 183956 - RNA, 1698 nt, Artificial Sequence
  derived and/or modified sequence opt5 from hemagglutinin__InfluenzaA__ABF47891
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugacccggaaaaacggccucuaucccaaucugucuaaguccuacgcuaacaauaaagaaaaggaggugcugguccucuggggagugcaucacccuccgaacaucggggaucagagagcccuguaccacacagaaaacgcuuaugugagcgucguuuccucucauuacagccgcagauucacccccgagauugccaaacggccuaaggugcgcgaccaggaaggcagaaucaauuauuacuggacgcuucuggagcccggggauacaauuaucuuugaggcgaacggaaaucucauugccccucgguaugcuuucgcccugucccgcggcuuugggagcggaaucauuaccucuaacgcucccauggacgaaugugaugccaagugccagacaccgcaaggcgcgaucaauuccagccuuccuuuccagaacgugcaccccgucaccaucggcgaguguccuaaauacgugagaucugccaagcugcggaugguuaccgggcuccgcaauauucccagcauccaguccagaggacuguuuggcgcuauugccggguucaucgaaggaggcuggacagggaugguggacggaugguauggcuaccaucaccagaacgagcaaggcucuggguacgcugccgaucagaaaagcacgcagaaugccauuaacggaaucaccaauaaggucaacuccgugaucgaaaagaugaauacacaguuuaccgcuguuggcaaagaguucaacaaacuggagcggcgcauggaaaaucucaacaagaagguggacgauggguuccuggacauuuggacauauaacgcggagcuucugguccuccuggaaaaugagagaacccuugacuuucacgauagcaacgugaaaaaucuguacgaaaaggucaaaucucaacucaagaacaaugccaaagagaucggaaacggcugcuucgaguuuuaucauaaguguaauaacgaaugcauggaguccgugaagaaugggacguacgacuaucccaaauacagcgaagagucuaagcugaaccgggagaaaauugauggcguuaagcuggaauccaugggaguguaucagauccucgcuauuuacagcacagucgccuccucucuggugcuucugguuagccucggcgccaucuccuucuggaugugcucuaaugggagccugcaguguagaaucugcauuuga

SEQ ID NO: 183957 - RNA, 1701 nt, Artificial Sequence
  derived and/or modified sequence opt5 from hemagglutinin__InfluenzaA__ABF47902
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaauccggagauauccugcucaucaauuguacaggcaaccugauugcuccccggggguauuucaagauccgcagcggaaagucuagcauuaugagauccgacgccucuaucggcaaaugcaauagcgaauguauuaccccuaacggcuccauccccaaugacaagccguuucagaacguuaaucggaucaccuacggggccugcccucgcuaugugaaacagaacacacuuaagcuggcgacgggaaugagaaaugugcccgagaaacaaacccggggcauuuucggggccaucgcuggauuuauugaaaacggcugggaggggauggucgauggaugguacggcuuccgccaccagaauagcgagggcacagggcaggccgcugaccucaagucuacccaagccgccaucaaccagauuaauggaaaacugaacagacuuaucgaaaagacaaaugagaaguuucaucagaucgaaaaagaguucuccgaaguggagggccggauucaggaucuggagaaguauguugaagacaccaaaaucgaucucuggagcuacaacgcugagcugcugguggcgcucgaaaaccaacacacgauugaccugacagauucugagaugaauaaacuuuucgaaagaaccaagaagcagcugcgcgagaacgccgaggacauggggaauggauguuuuaagaucuaucauaaaugcgauaacgcuugcauuggcuccauccggaaugggaccuacgaccacgaugucuacagagacgaagcccucaacaaucgcuuccagauuaagggcguggagcugaaaagcggauauaaggacuggauccuuuggaucuccuuugccauuucuuguuuccugcucugcguugugcugcugggcuuuaucaugugggcuugucagaaagggaacauucggugcaauaucuguauuuga

SEQ ID NO: 183958 - RNA, 1698 nt, Artificial Sequence
  derived and/or modified sequence opt5 from hemagglutinin__InfluenzaA__ABF47955
augaaggccaaacugcucgugcugcuuuacgcuuucgucgccaccgacgcggauacaaucugcauuggcuaucacgcuaacaauagcacggacaccguugauacaaucuuugagaagaacguggccgugacccauuccgucaaucugcucgaagacagacacaacgggaaacuguguaaacuuaagggaauugcuccccugcagcucggcaagugcaauaucacaggguggcugcugggaaacccugagugugauucucuccugccggcccggagcugguccuacauuguggaaacccccaauucugagaacggcgccugcuauccuggggacuucaucgauuacgaagaacuucgcgagcaacugagcuccguuucuagccucgaaagauuugagaucuuccccaaggaauccagcuggccuaaucauacauuuaacggagugaccgucucuuguucccaccggggcaaaagcucuuucuaucgcaaucugcuuuggcugacgaagaaaggcgacuccuaccccaagcucaccaacagcuaugugaauaacaaagggaaggagguucuggugcuguggggaguccaucacccuucuuccagcgaugagcagcagucccucuacucuaauggcaacgcuuacgugagcguggccuccagcaacuauaauagacgguuuacaccggaaauugcggcccgccccaaggucaaagaccagcacgggagaaugaacuacuauuggacccugcuugagccuggagauacaaucauuuucgaagcuaccggcaaucugaucgcccccugguacgcuuuugcccucucucggggguucgaguccggaauuaucacgagcaacgcgucuaugcaugaaugcaauacaaagugucaaaccccucagggcagcauuaacuccaaucugcccuuucagaacauccacccgguuacaaucggcgagugcccuaaauaugugcgcucuaccaagcugagaauggugaccgggcuucggaauauucccagcauccaguaccgcggacucuucggcgccauugcuggguuuaucgagggaggcuggacagggaugauugacggaugguauggcuaccaucaccaaaacgaacagggcuccggguacgccgcugaucagaaaagcacgcagaaugccaucaacagaaucaccaauaaggucaacucugugauugagaaaaugaauacacaauucaccgccguuggaaaggaguucaacaaccuggagaagcggauggaaaaucugaacaaaaagguggacgacggcuuucucgauaucuggacauauaaugcugagcugcuuguccugcucgagaacgaacgcacccuggacuuccacgaucuuaaugugaaaaaccuguacgagaagguuaaaucccagcucaagaauaacgcgaaggaaauugggaauggauguuuugaguucuaucauaaaugcgacaacgaauguauggagagcgugagaaauggcacguacgauuauccuaaguacucugaggaauccaaacugaaccgggagaagaucgacggggucaaacuggaaagcaugggcguguaucagauucucgccaucuacuccacagucgcuucuagccuggugcuucugguuucccucggagccaucucuuuuuggaugugcagcaauggcucccugcaaugcagaauuuguaucuga

SEQ ID NO: 183959 - RNA, 1698 nt, Artificial Sequence
  derived and/or modified sequence opt5 from hemagglutinin__InfluenzaA__ABF60576
augaagaccacaaucauucugauccuccugacgcacgccguggacagccagaaccccauuuccggcaauaacaccgcuacacuuugccuggggcaucacgccgucgcgaauggaacccucguuaaaacaaucaccgaugaccaaauugaggugacaaacgcuaccgaacuggugcagucuacgagcaucggcaagaucuguaauaacccuuacagaguccuugaugggcggaauugcacccugauugacgccaugcucggagauccgcauugugacguguuccaguaugagaacugggaucuguuuaucgaacgcuccucugccuucagcaauugcuaccccuaugacauuccugauuacgcuucccugagaucuaucguugccagcuccggcacacucgaguuuaccgcugaaggguucacauggaccggagugacgcagaacggcggcagcggggccugucggcgcggaucugcggacuccuuuuucagcagacugaauuggcuuacaaaaucuggcaacuccuaucccacccugaaugucacaaugccuaacaaugauaacuuugacaagcucuacauuugggggauccaccaucccagcaccaacaaugagcaaaccaaacuguaugugcaggagcuuggacggguuacagugucuacgaagcgcucccagcagaccauuaucccuaacaucggcagcagaccggggguccggggacaagccggccgcauuuccaucuacuggacaauugugaagcccggcgauauccugaugauuaauucuaacgggaaucucguggcuccuagaggauacuucaaaaugcggaccggcaagagcuccaucaugcgcagcgacgcccccaucgacacaugcuggucugaauguauuaccccuaacggguccauccccaaugauaaaccguuucagaacgucaauaagguuacguauggaaaaugcccuaaguacauuaagcagaacacacugaaacuggcuaccggcaugagaaaugugcccgagaagcagauccgggggauuuucggagccaucgcgggcuuuaucgaaaacggcugggaggggaugguggacggaugguauggcuuccgcuaccaaaauagcgaggggaccggacaggccgcugaucucaaaucuacacaggccgcuauugaccaaaucaacggcaagcugaauagagucauugaacggaccaacgagaaauuucaccagaucgaaaaggaguucagcgaaguggaggggcgcauucaggaucuugagaaauauguugaagacacaaagaucgaucugugguccuacaacgccgagcuccugguggcccuugaaaaucagcacacgauugaccugaccgaugcugagaugaacaaacucuucgaaaagacaagacggcaacugagagagaaugcggaggacaugggcggaggcuguuuuaagaucuaucauaaaugcgauaacgccuguaucgggucuauucgcaauggaaccuacgaccacuacaucuaucgggacgaagcucugaacaauagauuccagauuaagggcgucgagcucaaaagcggguacaaggauuggauccuguggauuuccuuugccaucagcugcuuccuuaucugcgugguucugcucggauuuauuaugugggccugugaaaagggcaacauccgcugcaauauuuguaucuga

SEQ ID NO: 183960 - RNA, 1701 nt, Artificial Sequence
  derived and/or modified sequence opt5 from hemagglutinin__InfluenzaA__ABF60577
augaagaccaucauugugcugagcuacuucuuuugccucgcccugucccaggacuauucugagagcaacaauuccacagcuacgcuuugucugggccaccaugccguccccaacgggaccaucguuaaaacaauuaccgaugaccaaaucgaagugacaaaugcgaccgagcucgugcagucuagcuccacaggaaagauuugcaacaauccucacagaauccuggauggccgggacuguacccuuaucgaugcucugcucggggacccgcauugcgaugucuuccaggacgaaacgugggaucuguacguggagcgcucuagcgccuuuuccaacuguuaucccuacgacguuccugauuaugccagccugagaucucucguggcuuccagcggaacccuggaguucauuacagaaggcuuuaccuggacaggggucacccagaauggaggcucuaacgccugcaaacggggccccgcuuccggguucuuuagccgccuuaauuggcugacgaagucuggauccacauacccugugcucaacguuaccaugcccaaugacgauaacuucgacaaacuguauguguggggcguccaccauccuagcacaaaucaagagcagaccgaccuuuacgugcaggccuccgggagagugaccgucucuacacggcgcagccagcaaacgaucauuccgaacaucggauccagacccuggguucggggccagagcgggcgcauuucuaucuacuggaccauugugaagccuggagaugugcuggucaucaauuccaacggcaaccucaucgcgcccagaggcuauuuuaagauucggacagggaaaagcucuaucaugcgcagcgacgccccuauugauaccuguaucuccgaaugcauuacacccaauggaucuaucccgaacgacaagccuuuccagaaugugaacaaaaucaccuacggcgcuugucccaaguauguuaaacagagcacgcugaagcuggccacagggaugagaaaugugccugagaagaaaacccggggacucuuugucgcuauugccggcuucaucgaaaacgggugggagggaaugauugauugcugguacggcuuucgccaccaaaauuccgagggcaccgggcaggcggccgaccuuaagagcacacaggcugccaucgaucaaauuaacggaaaacugaauagagugaucgaaaagaccaacgagaaauuccaccagaucgaaaaggaguucucugaaguugagggccggauucaggaccuggagaauuauguggaagauacaaaaaucgaccucugguccuacaacgcugagcugcuugucgcccuggaaaaucagcauacgauugaucucaccgacagcgagaugaacaagcuguuugaaagaacacgccggcaacugagagagaaugccgaggacauggggucuggauguuucaagaucuaucacaaaugcgauaacgcuugcauugaauccauccgcaacggcaccuacgaccaugauauuuaccgggacgaggcgcucaauaacagauuucagaucaaggggguggaacugaaaagcggcuauaaggauuggauccuuuggauuuccuucgccacaucuuguuuucugcucugcgucgugcugggaggcuucaucaugugggcuugucagcgcgggaauauucggugcaacaucuguauuuga

SEQ ID NO: 183961 - RNA, 1701 nt, Artificial Sequence
  derived and/or modified sequence opt5 from hemagglutinin__InfluenzaA__ABF60578
augaagaccaucauugugcugagcugcuucuuuugucucgccuucucccaggaccugucugagaacaauaacaauacagcuacgcuuugccugggccaccaugccguccccaacgggaccaucguuaaaacaauuaccgaugaccaaaucgaagugacaaaugcgaccgagcucgugcagagcuccucuacaggaaagauuuguaacaauccucacagaauccuggauggccgggacugcacccuuaucgaugcucugcucggggacccgcauugugaugucuuucaggacgaaacgugggaucuguacguggagcgcagcaaauccuucucuaacugcuaucccuacgacguuccugauuaugccagccugagaucccucguggccagcucuggaacccuggaauuuauuacagaggcuuucaccuggacaggcgucacccagaaugggggauccggcgccuguaagcggggccccgggaacggauuuuucagccgccuuaauuggcugacgaaaucuggcuccgcuuacccugugcucaacguuacaaugcccaauaacgacaauuuugauaagcuguauguguggggaguccaccauccuagcaccaaccaagagcagacaaaccuuuacgugcaggccucugggagagugaccgucuccacccggcgcagccagcaaacaaucauuccgaauaucggcuccagacccuggguucgggggcagucucgcagaauuagcaucuauuggacgauugugaagccuggagacauccuggugaucaacuccaauggcaaccucauugcgccccggggcuacuucaaaaugcgcaccgggaaguccucuaucaugagauccgacgccccuauugauacaugcaucagcgaauguauuacccccaauggaucuaucccgaacgacaaaccuuuucagaaugucaacaagaucacauacggcgcuugccccaaauauauuaagcagagcacccugaagcuggccacggggaugcggaaugugccugagaaacaaacacgcggacucuucggcgcuaucgccggguuuauugaaaacggaugggagggcaugaucgauggcugguacggguucagacaccagaauagcgagggaaccggccaggcggccgaccugaagucuacccaagcugccauugaucagaucaacgggaaacuuaaucggguuaucgaaaagacaaacgagaaauuccaccagauugaaaaggaguuuagcgaaguggagggaagaauccaggaccuggagaaauaugucgaagauaccaagauugaccucugguccuacaaugcugaugugcugguugcccuugagaaccaacauacaaucgaccugacggauagcgaaaugaacaaacucuucgagaagacccgccggcagcugagagaaaaugccgaggacaugggcaacggguguuuuaagauuuaucacaaaugcgacaaugcuugcaucgagucuauucgcaacggcacauacgaucaugacaucuaucgggaugaagcgcugaauaacagauuccagaucaagggauguggcgugaaauccggguacaaggacuggauucucuggaucagcuuugccauuucuugcuuccugcuuugugucgugcugcucggauuuaucaugugggcuugccagcgcggcaauauucgguguaacaucugcaucuga

SEQ ID NO: 183962 - RNA, 1701 nt, Artificial Sequence
  derived and/or modified sequence opt5 from hemagglutinin__InfluenzaA__ABF60579
augaagacccugaucgcccucagcuacauuuucugccuggugcuuggccaggaccugcccgggaacggaaauuccacagcuacgcucugucugggccaccaugccgucccuaacgggacccuuguuaaaacaaucaccgaugaccaaauugaggugacaaaugcgaccgaacuggugcagaacuuuucuauggauaagaucugcaauaacccgcaccggauucucgacggagcuaauuguacacugaucgaugcccugcucggcgacccccauugcgaugacuuccagaacgagaaaugggaucuguuugucgaaagaagcaaggccuucuccaauuguuauccuuacgacgugcccgauuauaccucucuucgcagccugaucgcuuccucugggacgcucgaguuuauuaacgaagacuucaauuggaccggaguuacacagaacggcggcagcaaugccugcaaaagagggccugauuccagcuuuuucucucggcugaacuggcuuuacaaguccggaaauaccuaucccaugcugaacgugacaaugccuaacagcgacaauuuugacaagcucuacaucuggggcguccaccauccgucuaccgcucgcgagcaaacgaaccuguaugugcaggccuccgggaaaguuacagugagcaccaagagaucucagcagacaauuauccccaauauuggaucccggccuuggguccgcggccugagcuccagaaucucuauuuacuggaccaucgugaaacccggggauauccucgugauuaacagcaauggaaaccugaucgcgccucggggcuacuucaagaugcacaccggccgcuccagcauuaugagaucugacgcccccaucgauacauguuccagcgagugcauuacgccgaaugggucuaucccuaacgacaaacccuuucaaaaugucaacaagaucaccuauggagcuuguccuaaguacguuaaacagaauacacuuaagcuggccaccggcaugcggaacauucccgaaaaacagacacgcgggaucuucggagcuauugccggcuuuaucgagaaugggugggaaggaaugguggauggcugguauggcuucagacaccagaacagcgaggggaccggacaagcggccgaccucaaguccacgcaggcugccauugaucagaucaauggcaaacugaaccgggugaucgagaagacaaacgaaaaauuccaucaaauugagaaggaauuuucuggggucgagggacgcauccaggaccuugaaaaguacguggaggauaccaaaauugaccuguggagcuauaaugcugagcuccugguugcccuggaaaaccagcacaccaucgaucucacagacuccgagaugaauaagcuguucgagaaaaccagacggcagcuuagagaaaacgccgaagacaugggcaaugggugcuuuaagauuuaccauaaaugugauaacgcuugcaucgagagcauucgcaauggcacauaugaccacaacgaguaccgggaugaagcgcugaauaacagauuccaaaucaagggaguggagcucaagucuggcuacaaagacuggauccuguggauuuccuuugccaucagcugcuuccuucugugugucgugcuccugggguuuauuaugugggcuugccagaagggaaauauccgcuguaacauuugcaucuga

SEQ ID NO: 183963 - RNA, 1701 nt, Artificial Sequence
  derived and/or modified sequence opt5 from hemagglutinin__InfluenzaA__ABF60580
augaagaccaucauugcccugagcuacaucuucugccucgcuuuugcccaggaccugcccggcaacgauaauuccacagcgacgcuuugucuggggcaccaugcugugccuaacggaacccucgucaaaacaauuaccaaugaccaaaucgagguuacaaacgccaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuuguggaacggucuaaggcuuucagcaacuguuauccuuacgauguccccgacuaugccucccuccgcucucugguggcuagcuccgggacgcuugaguuuaucaaugaaggauucaacuggaccggcguuacacagaauggcgggagcucugccugcaaaagaggaccugauaacggcuuuuucucccggcugaauuggcucuacaagagcgggucuaccuaucccgugcaaaacgucacaaugccuaauaacgacaacuccgauaagcuguacauuuggggagugcaccauccgagcaccgacaaagagcagacggaccuuuauguucaggcgucuggcaaggugacagucuccaccaaacgcauccagcaaacagugauucccaauguggggagcagaccuuggguccggggacuguccucucgcguuagcaucuacuggaccauugugaagcccggcgaugugcucgucaucaacuccaauggcaaccugaucgccccuagaggguacuauaaaaugcggaccggaaagagcucuauuaugcgcuccgacgcucccaucggcacauguagcucugagugcauuacgccgaaugggagcaucccuaacgauaagcccuuucagaaugugaacaaaauuaccuacggagccuguccuaaguauguuaaacagaauacacugaagcucgcuaccggcaugagaaacgugcccgaaaaacagacacgggggaucuucggagccaucgcgggcuuuauugagaauggcugggaagggaugaucgacggaugguacggcuuccgccaccaaaacuccgaggggaccggacaggccgcugaucugaagucuacgcaggccgcuauugaccaaaucaauggcaaacuuaacagagucauugagaagacaaaugaaaaguuucaccagaucgagaaagaguucagcgaaguggaagggcggauccaggaucuggagaaguauguugaggacaccaaaauugaucucugguccuacaacgccgaagugcuggucgcccuugagaaccagcauaccaucgaccugacagauagcgaaaugaauaaacucuucgagaagacccgcagacaacugcgggaaaacgcugaggacaugggcaauggaugcuuuaagauuuaucacaagugugacaacgcgugcaucggcucuauuagaaaugggacauacgaucaugacguguaccgcgaugaggcccugaacaaucgguuccagaucaaaggagucgaacucaaguccggcuauaaagacuggauucuguggaucagcuuugcuaucucuugcuuccuucugugugugguucuccugggguuuauuaugugggccugccagaagggaaacaucagauguaauauuugcaucuga

SEQ ID NO: 183964 - RNA, 1701 nt, Artificial Sequence
  derived and/or modified sequence opt5 from hemagglutinin__InfluenzaA__ABF60581
augaagaccaucauugugcugagcuacuucuuuugccucgcccugucccaggacuauucugagagcaacaauuccacagcuacgcuuugucugggccaccaugccguccccaacgggaccaucguuaaaacaauuaccgaugaccaaaucgaagugacaaaugcgaccgagcucgugcagucuagcuccacaggaaagauuugcaacaauccucacagaauccuggauggccgggacuguacccuuaucgaugcucugcucggggacccgcauugcgaugucuuccaggacgaaacgugggaucuguacguggagcgcucuagcgccuuuuccaacuguuaucccuacgacguuccugauuaugacagccugagaucucucguggccuccagcggaacccuggaguucauuacagaaggcuuuaccuggacaggggucacccagaauggaggcucuaacgcuugcaaacggggccccgccuccggguucuuuagccgccuuaauuggcugacgaagucuggauccacauacccugugcucaacguuaccaugcccaauaacgauaauuucgacaaacuguauguguggggcguccaccauccuagcacaaaccaagagcagaccaaucuuuacgugcaggcuuccgggagagugaccgucucuacacggcgcagccagcaaacgaucauuccgaacaucggauccagacccuggguucggggccagagcgggcgcauuucuaucuacuggaccauugugaagccuggagacgugcuggucaucaacuccaauggcaaccucaucgcccccagaggcuauuuuaagaugcggacagggaaaagcucuauuaugcgcagcgaugcgccuaucgacaccuguauuuccgaaugcaucacacccaauggaucuauuccgaacgauaugccuuuccagaaugugaacaagaucaccuacggcgccugucccaaauauguuaagcaggggacgcugaaacuggcuacaggaaugagaaaugugccugagaagcaaacccggggccucuuuggggccaucgcuggauucauugaaaacggcugggagggcaugaucgacgggugguacggauuucgccaccagaauagcgagggcaccgggcaggccgcggaucugaaguccacacaagccgcuauugaccagaucaacggaaaacuuaauagagucauugaaaagaccaacgagaaauuccaccagaucgaaaaggaguucagcgaaguggagggccggauccaggaucuggagaaauauguugaagacacaaagauugaucucuggucugacaaugccgagcugcuuguggcucuggaaaaccaacauacgaucgaucucaccgacuccgagaugaauaaacuguuugaaaagacaagacgccagcugcgggagaacgccgaggucauggggaacggcugcuucaagauuuaccacaaaugugacaaugccugcaucgaaagcauuagaaacggaaccuaugaucaugacaucuaccgcgaugaggcucucaauaaccgguuucagauuaagggcguggaacugaaaucuggguacaaggacuggauccuuuggaucuccuucgcgauuagcugcuuucugcucugugucgugcugcuuggauucaucaugugggccugccagagaggcaauauucgcuguaacaucugcauuuga

SEQ ID NO: 183965 - RNA, 1701 nt, Artificial Sequence; identical to SEQ ID NO: 183764
  derived and/or modified sequence opt5 from hemagglutinin__InfluenzaA__ABF82651

SEQ ID NO: 183966 - RNA, 1698 nt, Artificial Sequence; identical to SEQ ID NO: 183824
  derived and/or modified sequence opt5 from hemagglutinin__InfluenzaA__ABF82662

SEQ ID NO: 183967 - RNA, 1698 nt, Artificial Sequence
  derived and/or modified sequence opt5 from hemagglutinin__InfluenzaA__ABF82673
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaaggcucuuggagcuacauuguugagaccccgaaucccgaaaacgggacguguuauccuggauacuuugccgacuaugaggagcugagagaacaacucuccucugugagcuccuucgagcgguuugaaaucuuccccaagggcagcucuuggccuaaucauaccgucacaggcguguccgcuagcugcucucacaacgggaaguccagcuuuuaccgcaaucugcuuuggcugaccgggaaaaacggccucuaucccaaucugucuauguccuacguuaacaauaaggagaaagaggugcugguccucuggggagugcaucacccuccgaacaucggagaucagagagcccuguaccacacagaaaacgcuuaugugagcgucguuuccucucauuacagccggcgcuucacccccgagauugccaagagaccuaaagugcgggaccaggaaggccgcaucaauuauuacuggacgcuucuggagcccggggauacaauuaucuuugaagcgaacggaaaucucauugccccuugguaugcuuucgcccuguccagaggcuuuggcagcgggaucauuaccucuaacgcucccaugggagagugugacgccaagugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggcuggacagggaugguggauggaugguauggcuaccaucaccagaacgagcaagggucuggauacgcugccgaccaaaagagcacgcagaaugccauuaacggcaucaccaauaaagucaacuccgugaucgaaaagaugaauacacaguuuaccgcuguugggaaagaguucaacaagcuggaacgcagaauggagaaucucaacaaaaagguggaugacggcuuccuggauauuuggacauauaacgcggagcuucugguccuccuggaaaaugagcggacccuugacuuucacgacagcaacgugaagaaucuguacgaaaaagucaagucucagcucaaaaacaaugccaaggagaucggaaacggcugcuucgaauuuuaucauaaauguaauaacgagugcauggaguccgugaagaaugggacguacgauuaucccaaguacagcgaagagucuaaacugaaccgcgaaaagauugacggaguuaaacuggaguccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 183968 - RNA, 1698 nt, Artificial Sequence; identical to SEQ ID NO: 183865
  derived and/or modified sequence opt5 from hemagglutinin__InfluenzaA__ABF82684

SEQ ID NO: 183969 - RNA, 1701 nt, Artificial Sequence; identical to SEQ ID NO: 183831
  derived and/or modified sequence opt5 from hemagglutinin__InfluenzaA__ABF82695

SEQ ID NO: 183970 - RNA, 1701 nt, Artificial Sequence; identical to SEQ ID NO: 183807
  derived and/or modified sequence opt5 from hemagglutinin__InfluenzaA__ABF82706

SEQ ID NO: 183971 - RNA, 1698 nt, Artificial Sequence; identical to SEQ ID NO: 183323
  derived and/or modified sequence opt5 from hemagglutinin__InfluenzaA__ABF82819

SEQ ID NO: 183972 - RNA, 1698 nt, Artificial Sequence; identical to SEQ ID NO: 183824
  derived and/or modified sequence opt5 from hemagglutinin__InfluenzaA__ABF82830

SEQ ID NO: 183973 - RNA, 1698 nt, Artificial Sequence; identical to SEQ ID NO: 183824
  derived and/or modified sequence opt5 from hemagglutinin__InfluenzaA__ABF82841

SEQ ID NO: 183974 - RNA, 1698 nt, Artificial Sequence; identical to SEQ ID NO: 183824
  derived and/or modified sequence opt5 from hemagglutinin__InfluenzaA__ABF82852

SEQ ID NO: 183975 - RNA, 1698 nt, Artificial Sequence
  derived and/or modified sequence opt5 from hemagglutinin__InfluenzaA__ABF82863
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguucuacguuaacaauaaggagaaagaagugcugguccucuggggcgugcaucacccuccgaacaucggggaucagagagcccuguaccacacagagaacgcuuauguguccgucguuagcucccauuacucucggcgcuuuacccccgaaauugccaagagaccuaaagugcgggaccaggagggacgcaucaauuauuacuggacgcuucuggaacccggcgauacaauuaucuucgaggcgaacgggaaucucauugccccuugguaugcuuuugcccugagcagaggauucggcuccggcaucauuaccagcaacgcucccaugggggagugugacgccaagugccagacaccgcaaggagcgaucaauucuucccuuccuuuucagaacgugcaccccgucaccaucggcgaauguccuaaguacgugcggagcgccaaacugcgcaugguuaccgggcucagaaauauucccucuauccagagccggggacuguucggcgcuauugccggguuuaucgagggaggcuggacaggcaugguggaugggugguauggauaccaucaccagaacgaacaaggcuccggguacgcugccgaccagaagucuacgcagaaugccauuaacggaaucaccaauaaagucaacagcgugaucgagaagaugaauacacaguucaccgcuguuggcaaagaguucaacaagcuggaacgcagaauggagaaucucaacaaaaagguggaugacggguuucuggauauuuggacauauaacgcggaacuucugguccuccuggagaaugaacggacccuugacuuccacgacuccaacgugaagaaucuguacgagaaagucaagagccaacucaaaaacaaugccaaggaaaucggcaacggaugcuuugaguucuaucauaaauguaauaacgagugcauggaaucugugaagaauggcacguacgauuaucccaaguacuccgaggaaagcaaacugaaccgcgagaagauugacgggguuaaacuggagucuaugggaguguaucagauccucgcuauuuacuccacagucgccagcucccuggugcuucugguuucucucggcgccaucagcuuuuggaugugcuccaaugggucucugcaguguagaaucugcauuuga

SEQ ID NO: 183976 - RNA, 1698 nt, Artificial Sequence
  derived and/or modified sequence opt5 from hemagglutinin__InfluenzaA__ABF82874
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucggggaucagagagcccuguaccacacagagaacgcuuaugugagcgucguuuccucucauuacagccggcgcuucacccccgaaauugccaagagaccuaaagugcgggaccaggagggacgcaucaauuauuacuggacgcuucuggaacccggcgauacaauuaucuuugaggcgaacgggaaucucauugccccuugguaugcuuucgcccuguccagaggauuuggcagcggcaucauuaccucuaacgcucccaugggggagugugacgccaagugccagacaccgcaaggagcgaucaauuccagccuuccuuuccagaacgugcaccccgucaccaucggcgaauguccuaaguacgugcggucugccaaacugcgcaugguuaccgggcucagaaauauucccagcauccagucccggggacuguuuggcgcuauugccggguucaucgagggaggcuggacaggcaugguggaugggugguauggauaccaucaccagaacgaacaaggcucuggguacgcugccgaccaaaagagcacgcagaaugccauuaacggaaucaccaauaaagucaacuccgugaucgagaagaugaauacacaguuuaccgcuguuggcaaagaguucaacaagcuggaacgcagaauggagaaucucauuaaaaagguggaugacggguuccuggauaucuggacauauaacgcggaacuucugguccuccuggagaacgaacggacccuugacuuucacgacagcaaugugaagaaccuguacgagaaagucaagucucagcucaaaaauaacgccaaggaaauuggcaauggaugcuucgaguuuuaucauaaauguaacaaugagugcauggaauccgugaagaacggcacguacgauuaucccaaguacagcgaggaaucuaaacugaaucgcgagaagaucgacgggguuaaacuggaguccaugggaguguaucagauucucgcuaucuacagcacagucgccuccucucuggugcuucugguuagccucggcgccaucuccuucuggaugugcucuaacgggagccugcaguguagaauuugcaucuga

SEQ ID NO: 183977 - RNA, 1698 nt, Artificial Sequence; identical to SEQ ID NO: 183824
  derived and/or modified sequence opt5 from hemagglutinin__InfluenzaA__ABF82885

SEQ ID NO: 183978 - RNA, 1698 nt, Artificial Sequence; identical to SEQ ID NO: 183824
  derived and/or modified sequence opt5 from hemagglutinin__InfluenzaA__ABF82896

SEQ ID NO: 183979 - RNA, 1698 nt, Artificial Sequence; identical to SEQ ID NO: 183824
  derived and/or modified sequence opt5 from hemagglutinin__InfluenzaA__ABF82907

SEQ ID NO: 183980 - RNA, 1698 nt, Artificial Sequence; identical to SEQ ID NO: 183868
  derived and/or modified sequence opt5 from hemagglutinin__InfluenzaA__ABF82929

SEQ ID NO: 183981 - RNA, 1698 nt, Artificial Sequence; identical to SEQ ID NO: 183824
  derived and/or modified sequence opt5 from hemagglutinin__InfluenzaA__ABF82940

SEQ ID NO: 183982 - RNA, 1701 nt, Artificial Sequence
  derived and/or modified sequence opt5 from hemagglutinin__InfluenzaA__ABF83447
augaagaccaucauugcccugagcuacaucuucugccucgcucugggccaggaccuucccgggaacgauaauaacacagccacgcugugucucggacaccaugcggugccuaauggcacccuggucaaaacaauuaccgacgaucaaaucgagguuacaaacgcuaccgaacuugugcaguccucuagcacagggaagauuugcaauaacccgcacagaauccuggacggaaucgauuguacccucauugacgcccugcugggcgauccccauugcgacguguuucagaaugagacgugggaucucuucgucgaacgguccaaagccuuuucuaacuguuauccuuacgacgugcccgauuaugcuagccugcgcucccuuguugccucuagcgggacccuggaguucaucacagaaggauuuaccuggacaggcgugacccagaauggcggguccaacgcuugcaagagaggaccuggcagcggguucuuuucucggcucaauuggcugacgaaauccggaagcacauaccccguccuuaacgugaccaugccuaauaacgacaauuucgauaagcuguauauuuggggcguucaccauccgucuacaaaccaagagcagaccucccucuacgugcaggccagcgggggagucaccgugucuacacgcagaucccagcaaacgaucauucccaacaucggcagccggccuugggugcgcggccuguccucuagaauuagcaucuauuggaccaucgucaagcccggggacguucuggugauuaauuccaacggaaaucucaucgcgccucggggcuacuuuaaaaugcgcacaggaaagagcucuauuaugagauccgacgcccccaucgauaccuguauuagcgagugcaucacaccgaacgggucuaucccuaaugacaaacccuuccagaacgugaauaagauuaccuacggcgcuuguccuaaauaugucaagcagaacacgcugaaacuugccacagggaugcggaaugugcccgaaaagcagacccgcggacuguuuggcgcuaucgccggcuucauugagaacgggugggaaggaaugaucgauggcugguacggguuuagacaccaaaauagcgagggaaccggccaggcggccgaccucaaguccacacaggcugccauugaucaaaucaacgggaaacugaaucggguuaucgagaagaccaacgaaaaauuccaccagauugagaaggaguucucugaaguggaaggccgcauccaggaccuugagaaauaugucgaggauacaaagauugaccuguggagcuacaaugcugaacuccugguggcccuggagaaccagcauacgaucgaucucaccgacuccgaaaugaacaagcuguuugagaaaacaagacggcaacuuagagaaaaugccgaggauaugggaaacggcugcuucaagauuuaucacaaaugugacaaugcuugcaucgagagcauucgcaacgggaccuacgaccaugauguuuaucgggacgaagcgcugaauaacagauuucagaucaagggaguggagcucaaaucuggcuacaaggauuggauccuguggauuuccuucgccaucagcugcuuucuucugugugucgugcuccugggguucauuaugugggcuugccagcgcggaaauauccgguguaacauuugcaucuga

SEQ ID NO: 183983 - RNA, 1644 nt, Artificial Sequence
  derived and/or modified sequence opt5 from hemagglutinin__InfluenzaA__ABG20468
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcgagaagaucaacccugcuaaugaccucuguuauccggggaacuucaaugauuacgaggaacugaagcaucugcucucccggauuaaccacuuugagaaaauccagauuauccccaagucuagcugguccgaccaugaagccucuagcggaguguccagcgccugcccuuaucagggcagaucuuccuucuuucgcaaugucguguggcugauuaaaaagaacaaugcuuaccccaccaucaaacggagcuauaacaauacaaaccaagaggaucuucugguucucugggggauucaccacccuaaugacgccgcugaacagacccgccuguaccagaaccccacaaccuauaucucugugggaacguccacccuuaaccagagacuggucccuaagaucgccacacggagcaaggugaauggccaaucuggccgcauggaguucuuuuggaccauucucaaaccgaacgaugcgaucaauuucgaguccaacgggaauuuuauugcccccgaaaacgcuuacaagaucgugaaaaagggagacagcacaauuaugaaauccgagcuggaauacggcaauuguaacaccaagugcgagacgccuaucggggccaucaauucuagcaugcccuuccauaacauucacccucugacaaucggagaaugucccaaauaugucaaguccaauagacucguucuggcuaccggccuucggaacagcccgcagggggagcgcagacggaagaaacgcggacuguuuggcgccauugcgggcuucaucgaagggggauggcagggcaugguggaugggugguacggauaucaucacucuaaugaacagggcuccggguacgccgcugacaaggagagcacacaaaaagccauugacggagugaccaacaaggucaauucuaucaucgauaaaaugaacacccaguuugaagcugugggcagagaguucaacaaucucgaacggcgcauugagaaccugaauaagaagauggaggacggcuuucuugauguuuggacauauaacgccgaacugcucgugcugauggagaaugaaagaacgcuggacuuccacgauagcaacgucaaaaaucucuacgacaaggugcggcugcagcuuagagauaacgccaaagagcuggggaauggaugcuucgaauuuuaucaucgcugugacaacgagugcauggaguccguucggaauggcaccuacgauuacccucaauauucugaagaggcuagacucaagcgcgaagagaucagcggggugaaacuggaguccauuggaacauaccagauccuuagcauuuauucuaccgucgcguccagccuggcccucgcuaucaugguggccggccugucucuguggauguguuccaacgggagccuccagugccggauuugcaucuga

SEQ ID NO: 183984 - RNA, 1707 nt, Artificial Sequence
  derived and/or modified sequence opt5 from hemagglutinin__InfluenzaA__ABG20472
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaaagcgcacaaugggaagcucugugaucuggacggagugaaaccccuuauccugagagauugcagcguugcuggcuggcuccuggggaacccuaugugugacgaguuccugaaugugccggaaugguccuauaucgucgagaagauuaaccccgccaaugaucucugcuacccuggaaacuuuaaugacuaugaggaacugaagcaucuucugucucggaucaaccacuucgagaaaauucagaucauucccaagagcuccuggucugaucaugaagccagcuccggcgugagcucugcuuguccuuaccaggggcgcuccagcuuuuucagaaauguuguguggcucaucaaaaaggacaacgccuaucccacaauuaaacggucuuacaauaacaccaaucaagaggaucugcuuguccuguggggaauccaccacccuaacgacgcugccgagcagacacgccucuaucagaacccgaccacauacaucuccgugggcaccagcacgcugaaucagagacuggugcccaagauugcgacccggucuaaggucaacggccaauccgggcgcauggaauuuuucuggacaauccucaaaccuaaugaugccauuaacuuugagagcaauggaaacuucaucgcucccgaaaaugccuacaagauuguuaaaaagggcgacuccaccaucaugaaaucugagcuggaauaugggaacugcaauacaaagugucagaccccuaucggagcuauuaacagcuccaugcccuuucauaauauccacccgcuuacgauuggcgagugcccuaaauacgugaagucuaacagacuggugcucgccacagggcugcggaauagcccccagggagagcgcagacggaagaaacgcggccuuuucggcgcgaucgccggguuuauugaaggaggcuggcaggggauggucgacggaugguauggcuaccaucacuccaacgagcaagggagcggauaugcugccgauaaggaaucuacccagaaagcuaucgacggcgugacaaauaagguuaacagcaucauugauaaaaugaacacccaguucgaggccgugggcagagaauuuaauaaccuggagcggcgcaucgagaaucucaacaagaagauggaagacggguuccuggaugucuggaccuacaaugccgagcugcucgugcugauggaaaacgagagaacacuugacuuccacgauuccaauguuaaaaaccuguaugacaaggugcggcuccaacugagagauaaugcuaaagaacuuggaaacggcuguuuugaguucuaccaucgcugcgacaaugaguguauggaaucuguccggaacgggacguacgauuauccucaguacagcgaggaagcgagacugaagcgcgaggagauuuccggagugaaacucgaaagcaucggcaccuaucagauucugucuaucuacuccacagucgccagcucucuggcucucgccauuaugguggccgggcugucccuuuggaugugcagcaauggcucccugcagugccggaucuguaucuga

SEQ ID NO: 183985 - RNA, 1707 nt, Artificial Sequence
  derived and/or modified sequence opt5 from hemagglutinin__InfluenzaA__ABG20478
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuucugaaugugccggaaugguccuauaucgucgagaagauuaaccccgcuaaugaucugugcuacccuggaaacuucaaugacuaugaggaacucaagcaucugcuuucucggaucaaccacuuugagaaaauucagaucauucccaagagcuccuggucugaucaugaagccagcuccggcgugagcucugccuguccuuaccaggggcgcuccagcuucuuuagaaauguuguguggcugaucaaaaaggacaacgcuuaucccaccauuaaacggucuuacaauaacacaaaucaagaggaucuccugguccuuuggggaauccaccacccuaacgacgccgcugagcagacccgccuguaucagaacccgacaaccuacaucuccgugggcacgagcacccucaaucagagacuggugcccaagauugccacacggucuaaggucaacggccaauccgggcgcauggaguucuuuuggaccauccugaaaccuaaugaugcgauuaacuucgaaagcaauggaaacuuuaucgcccccgaaaaugcuuacaagauuguuaaaaagggcgacuccacaaucaugaaaucugagcucgaauaugggaacugcaauaccaagugucagacgccuaucggagccauuaacagcuccaugcccuuccauaauauccacccgcugacaauuggcgagugcccuaaauacgugaaaagcaacagacuugugcuggcuaccgggcuccgcaauucuccccagggagagcggagacggaagaaacgcggccuguuuggcgccaucgcgggguucauugaaggaggcuggcaggggauggucgacggaugguauggcuaccaucacuccaacgagcaagggagcggauaugccgcugauaaggaaucuacacagaaagccaucgacggcgugaccaauaagguuaacagcaucauugauaaaaugaacacccaguuugaggcugugggcagagaguucaauaaccuugaacggcgcaucgagaaucugaacaagaagauggaagacggguuccucgaugucuggacauacaaugccgagcugcuggugcucauggaaaacgagagaacgcuggacuuucacgauuccaauguuaaaaaccuuuaugacaaggugcggcugcaacucagagauaaugccaaagaacugggaaacggcuguuucgaguuuuaccaucgcugcgacaaugaguguauggaaucuguccggaacgggaccuacgauuauccucaguacagcgaggaagcuagacuuaagcgcgaggagauuuccggagugaaacuggaaagcaucggcacauaucagauucucucuaucuacuccaccgucgcgagcucucuggcccuggcuauuaugguggccgggcucucccuguggaugugcagcaauggcucccuucagugccggaucuguaucuga

SEQ ID NO: 183986 - RNA, 1701 nt, Artificial Sequence; identical to SEQ ID NO: 183807
  derived and/or modified sequence opt5 from hemagglutinin__InfluenzaA__ABG26758

SEQ ID NO: 183987 - RNA, 1701 nt, Artificial Sequence
  derived and/or modified sequence opt5 from hemagglutinin__InfluenzaA__ABG26769
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagaauagcagcacaggcagaauuugcgacuccccgcaccggauccuggaugggaaaaacuguacccucaucgacgcccugcugggagauccccauugcgacggcuuucagaauaaggagugggaucucuucgucgaacgcucuaaagccuauagcaacuguuacccuuaugacgugcccgauuacgcuucccugagaucucuuguugccagcuccgggacgcuggaguuuaauaacgaaucuuucaauuggaccggaguggcucagaacggcacaucuuaugccugcaagcggcgcuccgucaagagcuuuuucucuagacucaauuggcugcacaaacuugaguacaaguauccugcgcugaacgugaccaugcccaauaacgacaaauuugauaagcucuacauuuggggcguucaucacccuuccacagacagcgaucaaaccucucuguacgugcaggccuccgggcgggucacggugagcacaaaacgcucccagcagaccgugaucccgaacauuggaucuggccccugggucagagggguuagcucccggaucagcauuuauuggacaaucgugaagccuggagacauucugcucaucaauucuaccggcaaccugaucgcuccccgcggguacuucaagauuagauccggaaaaagcucuaucaugcggagcgacgccccuauuggcaauuguaacuccgagugcaucacccccaauggcucuauuccgaacgauaagccuuuucaaaaugugaaccgcaucacauauggggcuugucccagauacgucaaacagaauacgcuuaagcuggccaccggaaugcggaacgugccugaaaaacagacacgcggcaucuucggggcgauugccggauuuaucgagaauggcugggaagggaugguugacggaugguauggcuucagacaccagaacagcgagggcaccgggcaagcugccgaucucaaguccacacaggcugccauuaaucagaucaacggaaaacugaaucggcuuauugagaagaccaacgaaaaguuucaucaaaucgagaaagaguucagcgaaguggaaggcagaauccaggaccuggagaaguacgucgaggauacgaaaauugaccucuggucuuauaacgccgaacugcugguggcucucgagaaucagcacacaaucgaucugaccgacuccgaaaugaacaaacuuuucgagcgcacccggaagcagcugagagaaaaugcggaggauauggggaacggaugcuuucgcauuuaccauaagugugacaaugccugcaucggcagcauucggaacgggacauacgaucacgacguuuauagagacgaggcucucaauaaccgcuuccaaaucaagggcguggaacugaaaucuggauacaaggauuggauucuuuggaucuccuuugccaucagcugcuuccugcucugugucgugcugcugggcuuuauuaugugggccugccagaaagggaauauccgguguaacauuugcaucuga

SEQ ID NO: 183988 - RNA, 1701 nt, Artificial Sequence; identical to SEQ ID NO: 183935
  derived and/or modified sequence opt5 from hemagglutinin__InfluenzaA__ABG26780

SEQ ID NO: 183989 - RNA, 1701 nt, Artificial Sequence
  derived and/or modified sequence opt5 from hemagglutinin__InfluenzaA__ABG26791
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugaaggagcaacuuucuagcguuuccagcuuugaacgguucgagaucuuucccaaggagucuuccuggccuaaucauaccgugacaaaaggagucaccgcuagcugcucucacaacggcaaguccagcuucuacaaaaaucugcucuggcugacagaaaagaacggccuuuaucccaaucugucuaaauccuacgugaacaauaaggagaaggaaguucucgugcuguggggaguccaucacccuagcaacauuggggaucagcgcgccaucuaccacaccgagaacgcguauguguccguggucucuagccauuacuccagacgguuuacgccggaaaucgccaaacgccccaagguuagagaccaggagggccggauuaauuauuacuggacacugcucgagccuggggauaccaucauuuucgaagcuaacggaaaucugaucgcccccugguaugcuuuugcccuuagccgcggcuucgggucuggaauuaucacauccaacgcgagcaugggcgagugugacgccaaaugccagaccccucaaggcgcuauuaauucuagccugcccuuucagaacgugcacccggugaccaucggggaauguccuaaguacgucagauccacaaaacuccggauggugacgggacugcgcaauauccccucuauucagagcagaggccuuuucggggccaucgcuggauuuauugagggcggguggaccggaaugaucgauggcugguauggcuaccaucaccagaacgaacaaggguccggauacgccgccgacaagaaaagcacacagaaugcuauugauggcaucaccaacaagguuaauucugugaucgagaagaugaacacacaguucaccgcggucgggaaagaguucaauaagcuggaacggcgcauggagaaccucaauaaaaagguggacgauggauuucuggacauuuggacguauaacgccgaacugcucguucugcuugagaacgaaagaacacuggacuuccacgauuccaaugugaaaaaccucuacgagaaggucaagaaucagcugaaaaacaaugcuaaggagaucggcaacgggugcuuugaguucuaucauaaauguaauaacgaaugcauggaaagcgugaagaauggcaccuacgacuauccuaaauacucugaggaguccaaacuuaagcgggaaaagauugauggagucaagcuggagagcaugggcguguaucaaauccucgccauuuacuccaccguugccucuagccuggugcugcucgucucccugggggcuaucucuuuuuggaugugcagcaacggaucccuucagugucgcaucugcauuuga

SEQ ID NO: 183990 - RNA, 1701 nt, Artificial Sequence
  derived and/or modified sequence opt5 from hemagglutinin__InfluenzaA__ABG26802
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacgagaagugggaucuguucgucgaacgcuccaaagccuuuucuaauuguuauccuuacgacgugcccgauuaugcuagccucagaucccugguugccagcucugggacgcuugaguucauuaacgaaggauuuaauuggaccggcgugacacaguccggcgggagcuacgcuugcaagcggggaucugucaacuccuucuuuagccgccugaauuggcucuaugagucugaguccaaguacccugcccugaacgugaccaugcccaauaacggcaaauucgacaagcuguauaucuggggaguucaccauccuagcacagauaaagaacaaaccaaucuguacgugagagcguccgggcgggucacggugucuacaaagcgcagccagcagaccgugauuccgaacaucggccccagaccuuggguccgggggcucuccagccgcauuucuaucuacuggacaauuguuaaacccggagacauccugcugaucaacuccaccggcaaucucauugccccuagaggcuauuuuaagauccggaccgggaaguccucuauuaugcgcagcgaugcucccaucggaacauguuccucuggcugcauuacgccgaacgggagcaucccuaaugacaaacccuuccagaacgugaauaagaucaccuacggagccuguccuagauaugugaaacaaaacacacugaaacuugcuaccggcaugcggaauguccccgagaaacagacacgcgggauuuuuggagccaucgcgggcuucauugaaaacggcugggaggggaugguggacggaugguacggcuuuagacaccagaauagcgaggggaccggacaggccgcugaucuuaagagcacgcaagccgcuaucgaccagauuaacggcaaacucaaucggcugaucgaaaagacaaacgagaaguuccaccagaucgaaaaagaguucucugaaguugaggggcgcauucaagaucuugagaaguauguggaagacaccaaaaucgaucugugguccuacaaugccgagcuccuggucgcccuggaaaaccagcauaccauugacaugacagauagcgagaugaauaagcucuuugaaaagaccagaaagcagcugcgggagaacgcugaggacaugggcaacggaugcuucaagaucuaucacaaaugugauaaugcgugcauuggcucuaucagaaacgggacauacgaccaugauguguaccgcgacgaagcccuuaauaaccgguuucagauuaagggaguugagcugaaauccggcuauaaggacuggauccucuggaucagcuucgcuauuuccugcuuucugcuuugugugguccugcucggguucaucaugugggccugccaaaaaggaaauauuagauguaacaucugcauuuga

SEQ ID NO: 183991 - RNA, 1701 nt, Artificial Sequence; identical to SEQ ID NO: 183939
  derived and/or modified sequence opt5 from hemagglutinin__InfluenzaA__ABG26813

SEQ ID NO: 183992 - RNA, 1701 nt, Artificial Sequence
  derived and/or modified sequence opt5 from hemagglutinin__InfluenzaA__ABG26824
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaacauaauguuaccaagggagugacggcuucuugcucccacaaaggcaagagcucuuuuuaucgcaaccuccuguggcuuaccgagaagaauggcuccuacccuaaccugagcaaauccuaugucaauaacaaggaaaaagaggugcucguucuguggggagugcaucaccccucuaauaucgaagaccagaagacaauuuacagaaaagagaacgccuacgucagcgugguguccagccacuauaaccggcgcuucaccccugaaaucgcgaagagaccgaaaguccggaaucaggaggggcgcauuaacuacuauuggacacugcucgagcccggcgauaccaucauuuuugaagccaaugggaaccugaucgcuccuugguacgccuucgcucuuucuagaggauuuggcuccgggauuaucacgagcaaugccucuauggacgagugugaugcgaagugccagacaccccaaggagccaucaacagcucccugccuuuccagaauguucaucccgugaccauuggcgaauguccgaaguaugugcggucuacaaaacuccgcauggucaccggccugagaaacaucccuagcauucagucccgggggcuuuuuggagcuaucgccggcuucauugaagggggauggaccggcaugaucgacgggugguacggauaucaccaucagaaugaacaaggcagcggcuacgcugccgaucagaagucuacacagaacgccaucaaugggauuacgaacaaaguuaauuccaucauugagaagaugaacacccaguuuacagcugugggaaaagaguucaauaagcuggaaaagcgcauggagaaccucaacaaaaagguggacgauggcuuccuggacaucuggaccuacaaugcggaacugcucguccugcuugagaacgaaagaacacuggacuuucacgauagcaaugugaaaaaccucuaugagaagguuaaaucucaacugaagaauaacgccaaggagauugggaauggaugcuucgaauuuuaccacaaauguaacaaugagugcauggaauccgugaagaacggcaccuaugacuaccccaaauauagcgaggaguccaaacuuaaucgggagaagaucgauggggucaagcuggagucuaugggcguguaccagauccucgcuauuuauagcacggucgccuccucucuggugcugcucguuagccugggagccaucuccuucuggaugugcagcaacggcucucuucaguguaagauuugcaucuga

SEQ ID NO: 183993 - RNA, 1701 nt, Artificial Sequence; identical to SEQ ID NO: 183945
  derived and/or modified sequence opt5 from hemagglutinin__InfluenzaA__ABG26835

SEQ ID NO: 183994 - RNA, 1701 nt, Artificial Sequence
  derived and/or modified sequence opt5 from hemagglutinin__InfluenzaA__ABG26890
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuccgacaggcagaauuugcgacagcccccaccggauccuggaugggaaaaacuguacccucaucgacgcccugcugggagauccucauugcgacggcuuucagaauaaggagugggaucucuucgucgaacgcuccaaagccuauucuaacuguuaccccuaugacgugccugauuacgcuagccugagaucccuuguugccucuagcgggacgcuggaguuuaccaaugaaaacuucaauuggacaggaguggcucaggacggcaaguccuaugccugcaagcggggcagcgucaacucuuucuucucccgccucaauuggcugcacaaacuugaguacaaguaucccgcgcugaacgugaccaugccuaauaacgggaaauuugauaagcucuacauuuggggaguucaucacccgagcacagacucugaucagaccucccuguacgugagagccagcggcaaagucacggugucuacaaagcggucccagcagaccgugauccccgacauuggguaucgcccuugggucagaggacugagcucccggaucucuauuuacuggacaaucguuaagcccggcgacauucuccugaucaacagcaccgggaaucuuaucgcuccucgcggauauuucaaaauuagaaacggcaaguccagcaucaugcggucugaugcccccauuggcaauuguuccagcgagugcaucaccccgaacgggucuauuccuaaugacaaacccuuucagaacgugaaucgcaucacauacggagcuuguccuagauaugugaagcaaaacacgcugaaacucgccaccggcaugcggaauguccccgaaaagcagacacgcgggaucuucggagcgauugccggcuuuaucgagaacgggugggaaggaaugguggauggcugguacggcuucagacaccagaauagcgaggggaccggacaggcugccgaccugaaauccacacaagcugccauugaucagaucaacggcaaacuuaaucggcugguugagaagaccaacgaaaaguuucaucagauugagaaggaauuuucugagguggaagggagaauccaagaccucgagaaauaugucgaggauacgaagaucgaccuguggagcuacaaugccgaacugcucguggcucuggagaaccagcacacaauugaucuuaccgacuccgaaaugaacaaacuguucgagcgcacccggaagcagcucagagaaaaugcggaggauaugggaaacggcugcuuuaagaucuaccauaaaugugacaaugccugcauugggagcauccgcaacggcacauaugaccacgauguuuaccgggacgaggcucugaauaacagauuccagauuaagggaguggaacuuaaaucuggcuauaaggauuggauccuguggauuuccuuugccaucagcugcuuccuccugugugucgugcugcucggguuuaucaugugggccugccaaaaaggaaauauucgcuguaacaucugcauuuga

SEQ ID NO: 183995 - RNA, 1701 nt, Artificial Sequence
  derived and/or modified sequence opt5 from hemagglutinin__InfluenzaA__ABG26901
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuccgacaggcagaauuugcgacagcccccaccggauccuggaugggaaaaacuguacccucaucgacgcccugcugggagauccucauugcgacggcuuucagaauaaggagugggaucucuucgucgaacgcuccaaagccuauucuaacuguuaccccuaugacgugccugauuacgcuagccugagaucccuuguugccucuagcgggacgcuggaguuuaccaaugaaaacuucaauuggacaggaguggcucaggacggcaaguccuauagcugcaagcggggcucugucaacuccuuuuucagccgccucaauuggcugcacaaaucugaguacaaguaucccgcccuuaacgugaccaugccuaauaacgggaaauuugauaagcuguacauuuggggaguucaucacccguccacagacagcgaucagaccucucucuacgugagagcguccggcaaagucacggugagcacaaagcggucccagcagaccgugauccccgacauuggguaucgcccuugggucagaggacugucuagccggaucuccauuuacuggacaaucguuaagcccggcgacauucugcucaucaacagcaccgggaaucugaucgccccucgcggauauuucaaaauuagaaacggcaagucuuccaucaugcggagcgaugcucccauuggcaauuguucuagcgagugcaucaccccgaacggguccauuccuaaugacaaacccuuucagaacgugaaucgcaucacauacggagccuguccuagauaugugaagcaaaacacgcuuaaacuggcuaccggcaugcggaauguccccgaaaagcagacacgcgggaucuucggagccauugcgggcuuuaucgagaacgggugggaaggaaugguggauggcugguacggcuucagacaccaaaauucugaggggaccggacaggccgcugaccucaaaagcacacaggccgcuauugaucagaucaacggcaagcugaaucggcuuguugagaagaccaacgaaaaauuucaucagauugagaaggaguucuccgaaguggaagggagaauccaagaccuggagaaauaugucgaggauacgaagaucgaccucuggagcuacaaugccgaacugcugguggcccucgagaaccagcacacaauugaucugaccgacucugaaaugaacaaacuuuucgagcgcacccggaagcagcugagagaaaaugcugaggauaugggaaacggcugcuuuaagaucuaccauaaaugugacaaugcgugcauuggguccauccgcaacggcacauaugaccacgauguuuaccgggacgaggcccucaauaacagauuccagauuaagggaguggaacugaaaagcggcuauaaggauuggauccuuuggauuucuuuugcuaucuccugcuuccugcucugugucgugcugcugggguuuaucaugugggccugccaaaaaggaaauauucgcuguaacaucugcauuuga

SEQ ID NO: 183996 - RNA, 1701 nt, Artificial Sequence
  derived and/or modified sequence opt5 from hemagglutinin__InfluenzaA__ABG26912
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucagcaauuguaacuccgagugcauuacccccaauggcucuaucccgaacgacaaaccuuuucaaaaugugaaccgcaucacauauggggcuugucccagauacgugaagcagaauacgcuuaaacuggccaccggaaugcggaacgucccugaaaagcagacacgcggcauuuucggggcgaucgccggauuuauugagaauggcugggaagggaugguggauggaugguauggcuucagacaccagaacagcgagggcaccgggcaagcugccgaccucaaauccacacaggcugccaucgaucagauuaauggaaagcugaaccggcuuaucgagaagaccaaugaaaaauuucaucaaaucgagaaggaguucagcgaaguugaaggccgcauucaggaccuggagaaauacguggaggauacgaagaucgaccucuggucuuauaacgccgaacugcuggucgcucucgagaaucagcacacaauugaucugaccgacuccgaaaugaacaaacuuuucgagagaacccggaagcagcugagagaaaacgcggaggauauggggaauggaugcuuuaagaucuaccauaaaugugacaacgccugcauuggcagcauccgcaaugggacauacgaccacgauguguaucgggacgaggcucucaacaauagauuccaaauuaagggcguugaacugaaaucuggauacaaggauuggauccuuuggaucuccuuugccauuagcugcuuccugcucugugugguccugcugggcuuuaucaugugggccugccagaaagggaacauucgcuguaauaucugcauuuga

SEQ ID NO: 183997 - RNA, 1698 nt, Artificial Sequence
  derived and/or modified sequence opt5 from hemagglutinin__InfluenzaA__ABG26945
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcguccgggaaucucauugccccuugguaugcuuucgcccugagcagaggauuuggcucuggcaucauuaccuccaacgcucccaugggggagugugaugccaagugccagacaccgcaaggagcgaucaauagcucucuuccuuuccagaacgugcaccccgucaccaucggcgaauguccuaaguacgugcggagcgccaaacugcgcaugguuaccgggcucagaaauauucccuccauccagucucggggacuguuuggcgcuauugccggguucaucgagggaggcuggacaggcaugguggacgggugguauggauaccaucaccagaacgaacaaggcagcggguacgcugccgaucagaaguccacgcagaaugccauuaacggaaucaccaauaaagucaacagcgugaucgagaagaugaauacacaguuuaccgcuguuggcaaagaguucaacaagcuggaacgcagaauggagaaucucaacaaaaagguggacgauggguuccuggacauuuggacauauaacgcggaacuucugguccuccuggagaaugaacggacccuugauuuucacgacucuaacgugaagaaucuguacgagaaagucaagucccaacucaaaaacaaugccaaggaaaucggcaacggaugcuucgaguuuuaucauaaauguaauaacgagugcauggaaagcgugaagaauggcacguacgacuaucccaaguacucugaggaauccaaacugaaccgcgagaagauugaugggguuaaacuggagagcaugggaguguaucagauccucgcuauuuacuccacagucgccucuagccuggugcuucugguuucccucggcgccaucucuuucuggaugugcagcaaugggucccugcaguguagaaucugcauuuga

SEQ ID NO: 183998 - RNA, 1701 nt, Artificial Sequence
  derived and/or modified sequence opt5 from hemagglutinin__InfluenzaA__ABG26956
augaagaccaucauugcccugagcuacauccucugccugguguucgcucagaaacuucccggcaacgacaauagaacagccacgcugugucucgggcaccaugcggucccuaacggaacccugguuaagacaauuaccaaugaucaaaucgaggugacaaacgcuaccgaacuugugcaguccucuagcacaggccggauuugcgacuccccgcaccagauccuggauggggagaauuguacccucaucgacgcccugcugggagauccccauugcgacggcuuucagaacaaagaaugggaucucuucgucgagcgcucuaaggccuauagcaauuguuacccuuaugacgugcccgauuacguuucccugagaucucuuguggcuagcuccgggacgcuggaauuuaacaaugagagcuucaacuggaccggagucgcccaaaauggcacaucuuccgcuugcaaacggcgcagcgacaaguccuuuuucucuaagcucaacuggcugcaccagcuuaaauauaaguacccugcccugaaugugaccaugcccaacaaugagaaauuugauaagcucuauauuuggggcguucaucacccugggacagacagcgaucagaucucucuguacgcgcaggccuccggaagagugaccgucagcacgaaacggucccaacagacagugauuccgaacaucggcucucgccccugggugagaggggucagcucccggauuagcaucuacuggaccauuguuaagccuggagacauccugcucaucaacucuacaggcaaucugauugcuccccgcggguauuucaagaucagauccggaaaaagcucuauuaugcggagcgacgccccuaucggcaaguguaacuccgaaugcauuacccccaauggcucuaucccgaacgauaaaccuuuucagaaugugaaccgcaucaccuacggggcuugucccagauaugugaagcagaauacacuuaaacuggccacgggaaugcggaacgucccugagaagcaaacccgcggcauuuucggggcgaucgccggauuuauugaaaauggcugggaggggaugauggacggaugguacggcuucagacaccagaacagcgagggcacagggcaggcugccgaucucaaauccacccaagcugccaucaaucagauuaacggaaagcugaaucggcuuaucgaaaagacaaacgagaaauuucaucagaucgaaaaggaguucagcgaaguggagggccgcauucaggaccuggagaaauauguugaagauaccaagaucgaccucuggucuuacaaugccgagcugcugguggcucucgaaaaccaacacacgauugaucugacagacuccgagaugaacaaacuuuucgaaagaaccaagaagcagcugcgggagaaugcggaggauauggggaacggaugcuuuaaaaucuaucauaagugugacaaugccugcauuggcagcaucagaaacgggaccuacgaucacgacgucuaccgcgacgaagcucucaauaaccgguuccagauuaaaggcguggagcugaagucuggauauaaagauuggguucuuuggaucuccuuugccaucagcugcuuccugcucuguauugugcugcugggcuuuaucaugugggccugccagaaggggaauauuagauguaacaucugcauuuga

SEQ ID NO: 183999 - RNA, 1698 nt, Artificial Sequence
  derived and/or modified sequence opt5 from hemagglutinin__InfluenzaA__ABG37120
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcgaguccagcuuuuaccgcaaucugcuuuggcugaccgggaagaacggacucuaucccaaucugucuauguccuacguuaacaauaaagaaaaggaggugcugguccucuggggcgugcaucacccuccgaacaucgggaaccagagagcccuguaccacacagaaaaugcuuaugugagcgucguuuccucucauuacagccggcgcuucacccccgagauugccaaaagaccuaaggugcgggaucaggaaggacgcaucaacuauuacuggacgcuucuggagcccggcgacacaauuaucuuugaggcgaaugggaaccucauugccccuugguaugcuuucgcccuguccagaggauuuggcagcggcaucauuaccucuaaugcucccaugggggaaugugaugccaaaugccagacaccgcaaggagcgaucaacuccagccuuccuuuccagaaugugcaccccgucaccaucggcgaguguccuaaguacgugcggucugccaagcugcgcaugguuaccgggcucagaaacauucccagcauccagucccggggacuguuuggcgcuauugccggguucaucgaaggaggcuggacaggcaugguggacgggugguauggauaccaucaccagaaugagcaaggcucuggguacgcugccgaucagaaaagcacgcagaacgccauuaauggaaucaccaacaaggucaauuccgugaucgaaaagaugaacacacaguuuaccgcuguuggcaaagaguucaauaaacuggagcgcagaauggaaaaccucaacaagaaaguggacgauggguuccuggacauuuggacauauaaugcggagcuucugguccuccuggaaaacgagcggacccuugauuuucacgacagcaaugugaagaaccuguacgaaaaggucaaaucucaacucaagaauaacgccaaagagaucggcaauggaugcuucgaguuuuaucauaaguguaacaaugaaugcauggaguccgugaaaaacggcacguacgacuaucccaaguacagcgaagagucuaagcugaaucgcgagaaaauugaugggguuaagcuggaauccaugggaguguaucagauccucgcuauuuacagcacagucgccuccucucuggugcuucugguuagccucggcgccaucuccuucuggaugugcucuaacgggagccugcaguguagaaucugcauuuga

SEQ ID NO: 184000 - RNA, 1701 nt, Artificial Sequence
  derived and/or modified sequence opt5 from hemagglutinin__InfluenzaA__ABG37131
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacgggccgcaccagauccuugauggaaagaauuguacccugaucgacgcccuccugggcgauccccauugcgacggguuucagaacaaggagugggaucuguucgucgaacggagcaaagccuauuccaauuguuacccuuaugacgugcccgauuacgcuucucuccgcagccugguugccuccagcggaacgcuugaguuuaccaacgaaucuuucaauuggacaggcguggcucaaaacggcaccuccuaugccugcaagagagggagcgucaagucuuucuucucccggcugaauuggcuccacaaacuggaguacaaguauccugcgcuuaacgugacaaugcccaauaacgacaaauuugauaagcuguacauuuggggaguucaucacccuagcaccgacucugaucagacgucccucuacgugcagagcuccggccgcgucacagugucuaccaaaagaagccagcaaacagugaccccgaauaucgggucccggcccuggguccgcggaauuagcucuagaaucuccauuuauuggaccaucguuaagccuggcgacauucugcugaucaacagcacagggaaccucaucgcuccccggggauacuucaagauucgcagaggcaaaucuagcaucaugcgguccgacgccccuauugauaauuguaacucugagugcaucacgcccaauggcagcauuccgaacgacaagccuuuucagaaugugaaccgcaucaccuauggggccugucccagauacgugaaacagaauacacugaaacuugcuaccggaaugcggaacgucccugaaaaacagacacgcggcaucuucggggccauugcgggauuuaucgagaauggcugggaagggaugguggauggaugguauggcuucagacaccaaaacuccgagggcaccgggcaggccgcugaccucaagagcacgcaggccgcuauuaaucaaaucaacggaaaacugaaucggcugauugagaagacaaacgaaaaguuucaucagaucgagaaagaauuuucugagguugaaggcagaauccaggaucuugagaaguacguggaggacaccaaaauugaucugugguccuauaaugccgaacuccuggucgcccuggagaaccagcacaccaucgaccucacagauagcgaaaugaacaagcuguucgagcgcacccggaaacaacuuagagaaaaugcugaggacauggggaacggaugcuuuaagauuuaccauaagugugauaaugcgugcaucggcucuauucgcaacgggacauacgaccacgacguguaucgggaugaggcccugaauaacagauuccagaucaaaggcguugaacucaaguccggauacaaagacuggauucuguggaucagcuuugcuaucuccugcuuccuucugugugugguccuccugggcuuuauuaugugggccugccagaaggggaauauccgcuguaacauuugcaucuga

SEQ ID NO: 184001 - RNA, 1701 nt, Artificial Sequence; identical to SEQ ID NO: 183807
  derived and/or modified sequence opt5 from hemagglutinin__InfluenzaA__ABG37142

SEQ ID NO: 184002 - RNA, 1701 nt, Artificial Sequence
  derived and/or modified sequence opt5 from hemagglutinin__InfluenzaA__ABG37164
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacgauuuucagaacaaggagugggaccucuucgucgaacgcagcaaagccuauuccaauuguuacccuuaugaugugcccgacuacgcuucucugagaagccuuguugccuccagcggcacgcuggaguuuaccaaggaaggguucaacuggacaggaguggcucaggauggcaagucuuaugccugcaaacggggcuccgucaauagcuuuuucucucgccucaacuggcugcacaaacuugaguacaaguauccugcgcugaaugugaccaugcccaacaaugacaaguuugauaaacucuacauuuggggaguucaucacccuuccacagacagcgaccaaaccucucuguacgugcaggccuccgggagagucacggugagcacaaagcggucccagcagaccgugaucccgaacauuggcucucgccccugggucagagggaucagcucccggauuagcaucuauuggacaauuguuaagccuggagauauccugcucaucaauucuaccggcaaccugauugcuccccgcggguacuucaaaaucagaaacggaaaguccagcauuaugcggucugacgccccuaucggcaauuguaacagcgagugcauuacccccaauggcuccaucccgaacgauaaaccuuuucaaaaugugaaccgcaucacauauggggcuugucccagauacgugaagcagaauacgcuuaaacuggccaccggaaugcggaacgucccugaaaagcagacacgcggcauuuucggggcgaucgccggauuuauugagaauggcugggaagggaugguggacggaugguauggcuucagacaccagaacucugagggcaccgggcaagcugccgaucucaaaagcacacaggcugccaucgaccagauuaauggaaagcugaaccggcuuaucgagaagaccaaugaaaaauuucaucaaaucgagaaggaguucuccgaaguugaaggccgcauucaggaucuggagaaauacguggaggacacgaagaucgaucucuggagcuauaacgccgaacugcuggucgcucucgagaaucagcacacaauugaccugaccgauucugaaaugaacaaacuuuucgagagaacccggaagcagcugagagaaaacgcggaggacauggggaauggaugcuuuaagaucuaccauaaaugugacaacgccugcauuggcuccauccgcaaugggacauacgaucacgacguguaucgggaugaggcucucaacaauagauuccaaauuaagggcguugaacugaaaagcggauacaaggacuggauccuuuggaucucuuuugccauuuccugcuuccugcucugugugguccugcugggcuuuaucaugugggccugccagaaagggaacauucgcuguaauaucugcauuuga

SEQ ID NO: 184003 - RNA, 1701 nt, Artificial Sequence
  derived and/or modified sequence opt5 from hemagglutinin__InfluenzaA__ABG37175
augaagaccaucauugcccugagcuacauccucugccagguguucgcuaaaaagcugcccggcaacgacaauuccacagccacgcuuugucuggggcaccaugcggucccuaacggaacccucguuaaaacaauuaccaaugaucaaaucgaggugacaaacgcuaccgaacuggugcagucuagcuccacaggcagaauuugcgacucuccgcaccggauccuugaugggaagaauuguacccugaucgacgcccuccugggagauccccauugcgacggcuuucagaacaaagagugggaucuguucgucgaacgcagcaaggccuauuccaauuguuacccuuaugacgugcccgauuacgcuucucucagaagccugguugccuccagcgggacgcuugaguuuaccaacgaaggauucaauuggacaggcguggcucaggacggcaagucuuauuccugcaaacgggggagcgucaacucuuucuucucccgccugaauuggcuccacaagcuggaguacaaauauccugcccuuaacgugaccaugcccaauaacgauaaguuugacaaacuguacauuuggggaguucaucacccuagcacagauucugaccaaaccucccucuacgugcaggcgagcggcagagucacgguguccacaaagcggucucagcagaccgugaucccgaauauugggagccgccccugggucagaggaaucuccagccggauuucuaucuauuggacaauuguuaagccuggcgacauccugcugaucaacuccaccgggaaccucauugcccccagaggauacuucaaaaucagaaauggcaagagcucuauuaugcggagcgaugcuccuaucgacaacuguaauuccgagugcauuacccccaacggcucuaucccgaaugauaaaccuuuucaaaacgugaaucgcaucacauauggggccugucccagauacgugaagcagaacacgcugaaacuugcuaccggaaugcggaaugucccugaaaagcagacacgcggcauuuucggggccaucgcgggauuuauugagaacggcugggaagggaugguggacggaugguauggcuucagacaccagaauagcgagggcaccgggcaagccgcugaucugaaauccacacaggccgcuaucgaccagauuaacggaaagcucaaucggcugaucgagaagaccaacgaaaaauuucaucaaaucgagaaggaauuuagcgagguugaaggccgcauucaggaucuugagaaauacguggaggacacgaagaucgaucuguggucuuauaaugccgaacuccuggucgcccuggagaaccagcacacaauugaccucaccgauuccgaaaugaacaaacuguucgagcgcacccggaagcagcuuagagaaaaugcugaggacauggggaacggaugcuuuaagaucuaccauaaaugugacaaugcgugcauuggcagcauccgcaacgggacauacgaucacgacguguaucgggaugaggcccugaauaacagauuccaaauuaagggcguugaacucaaaucuggauacaaggacuggauccuguggaucuccuuugcuauuagcugcuuccuucugugugugguccuccugggcuuuaucaugugggccugccagaaagggaauauucgcuguaacaucugcauuuga

SEQ ID NO: 184004 - RNA, 1701 nt, Artificial Sequence
  derived and/or modified sequence opt5 from hemagglutinin__InfluenzaA__ABG37186
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggacaggcguggcucaagacggcaagucuuaugccugcaagcggggguccgucaacagcuuuuucucucgccugaauuggcuccacaaacuggaguacaaguauccugcgcuuaacgugaccaugcccaauaacgauaaauuugacaagcuguacauuuggggaguucaucacccuuccacagauagcgaccagaccucucucuacgugcaggccuccggcagagucacggugagcacaaaacggucccagcaaaccgugaucccgaauauugggucucgccccugggucagaggaaucagcucccggauuagcaucuauuggacaauuguuaagccuggcgacauccugcugaucucuuccaccgggaaccucauugcuccccgcggauacuucaagaucagaaacggcaaaagcucuauuaugcggagcgaugccccuaucgacaauuguaacuccgagugcauuacccccaauggcucuaucccgaacgauaagccuuuucagaaugugaaccgcgugacauauggggcuugucccagauacgucaaacagaauacgcugaaacuugccaccggaaugcggaacgugccugaaaagcagacacgcggcaucuucggggcgauugccggauuuaucgagaauggcugggaagggaugguugacggaugguauggcuucagacaccaaaacagcgagggcaccgggcaggcugccgaucugaaguccacacaggcugccauugaccaaaucaauggaaaacucaaccggcugauugagaagaccaaugaaaaguuucaucagaucgagaaagaguucagcgaaguggaaggcagaauccaggaucuugagaaguacgucgaggacacgaaaauugaucuguggucuuauaacgccgaacuccugguggcucuggagaaucagcacacaaucgaccucaccgauuccgaaaugaacaagcuguucgagcgcacccggaaacaacuuagagaaaacgcggaggacauggggaauggaugcuuuaagauuuaccauaagugugacaacgccugcaucggcagcauucgcaaugggacauacgaucacgacguuuauaaagaugaggcucugaacaaucgguuccagaucaagggcgugguccucaaaucuggauacaaggacuggauucuguggaucuccuuugccaucagcugcuuccuucugugugugguccuccugggcuuuauuaugugggccugccagaaagggaacaucagauguaauauuugcaucuga

SEQ ID NO: 184005 - RNA, 1701 nt, Artificial Sequence
  derived and/or modified sequence opt5 from hemagglutinin__InfluenzaA__ABG37197
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggaacggcguggcucaagacggcaagucuuaugccugcaagcggggguccgucaagagcuuuuucucucgccugaauuggcuccacaaacuggaguacaaauauccugcgcuuaacgugacaaugcccaauaacgauaaguuugacaaacuguacauuuggggaguucaucacccuuccaccgauagcgaccagacaucucucuacgugcaggccuccggcagagucaccgugagcacgaagcggucccagcaaacagugaucccgaauauugggucucgccccugggucagaggaaucagcucccggauuagcaucuauuggaccauuguuaagccuggcgacauccugcugaucaacucuacagggaaccucauugcuccccgcggauacuucaaaaucagaaauggcaaguccagcauuaugcggucugaugccccuaucgacaacuguaauagcgagugcauuacccccaacggcuccaucccgaaugauaaaccuuuucagaacgugaaucgcaucaccuauggggcuugucccagauacgugaagcagaacacacugaaacuugccacgggaaugcggaaugucccugaaaagcagacccgcggcauuuucggggcgaucgccggauuuauugagaacggcugggaagggaugguggacggaugguauggcuucagacaccaaaauucugagggcacagggcaggcugccgaucugaaaagcacccaggcugccaucgaccaaauuaacggaaagcucaaucggcugaucgagaagacaaacgaaaaauuucaucagaucgagaaggaguucuccgaaguugaaggccgcauucaggaucuugagaaauacguggaggacaccaagaucgaucuguggagcuauaaugccgaacuccuggucgcucuggagaaccagcacacgauugaccucacagauucugaaaugaacaaacuguucgagagaacccggaagcaacuuagagaaaaugcggaggacauggggaacggaugcuuuaagaucuaccauaaaugugacaaugccugcauuggcuccauccgcaacgggaccuacgaucacgacguguaucgggaugaggcucugaauaacagauuccagauuaagggcguugaacucaaaagcggauacaaggacuggauccuguggaucucuuuugccauuuccugcuuccuucugugugugguccuccugggcuuuaucaugugggccugccagaaagggaauauucgcuguaacaucugcauuuga

SEQ ID NO: 184006 - RNA, 1701 nt, Artificial Sequence
  derived and/or modified sequence opt5 from hemagglutinin__InfluenzaA__ABG37208
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacgagaagugggaucuguucgucgaacgcuccaaagccuuuucuaauuguuauccuuacgacgugcccgauuaugcuagccucagaucccugguugccagcucugggacgcuugaguucauuaacgaaggauuuaauuggaccggcgugacacaguccggcgggagcuacgcuugcaagcggggaucugucaacuccuucuuuagccgccugaauuggcucuauaagucugaguccaaauacccugcccugaacgugaccaugcccaauaacggcaaguucgacaaacuuuauaucuggggaguucaccauccuagcacagauaaggagcaaaccaaucuguacgugagagcguccgggcgggucacggugucuacaaaacgcagccagcagaccgugauuccgaacaucggccccagaccuuggguccgggggcucuccagccgcauuucuaucuacuggacaauuguuaagcccggagacauccugcugaucaacuccaccggcaaucucauugccccuagaggcuauuuuaagauccggaccgggaaaagcucuauuaugcgcagcgaugcucccaucggaacauguuccucuggcugcauuacgccgaacgggagcaucccuaaugacaagcccuuccagaacgugaauaaaaucaccuacggagccuguccuagauaugugaagcaaaacacacugaaacuugcuaccggcaugcggaauguccccgaaaagcagacacgcgggauuuuuggagccaucgcgggcuucauugagaacggcugggaagggaugguggacggaugguacggcuuuagacaccaaaauuccgaggggaccggacaggccgcugaucugaaaagcacgcaggccgcuaucgaccagauuaacggcaagcucaaucggcugaucgagaagacaaacgaaaaauuccaccagaucgagaaggaguucucugaaguugaagggcgcauucaagaucuugagaaauauguggaggacaccaagaucgaucugugguccuacaaugccgaacuccuggucgcccuggagaaccagcauaccauugacaugacagauagcgaaaugaauaaacucuuugagaagaccagaaagcagcugcgggaaaacgcugaggacaugggcaacggaugcuucaaaaucuaucacaagugugauaaugcgugcauuggcucuaucagaaacgggacauacgaccaugauguguaccgcgacgaggcccuuaauaaccgguuucagauuaaaggaguugaacugaaguccggcuauaaagacuggauccucuggaucagcuucgcuauuuccugcuuucugcuuugugugguccugcucggguucaucaugugggccugccaaaagggaaauauuagauguaacaucugcauuuga

SEQ ID NO: 184007 - RNA, 1701 nt, Artificial Sequence
  derived and/or modified sequence opt5 from hemagglutinin__InfluenzaA__ABG37230
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcaccaauccaaauacaaguauccugagcuuaacgugacaaugcccaauaacgggaaauuugacaagcuguacaucuggggaguucaucacccuagcaccgauucugaccagacaucccucuacgcgagagccagcggccgggugaccgucuccacgaaacgcucucagcagacagugauuccgaauaucggguucagacccugggugcggggacugagcucccgcauuagcaucuauuggaccauugucaagccuggcgacauccugcucaucaacucuacagggaaccugauugcucccagaggauacuuuaagauccggaauggcaaauccagcauuaugcgcucugaugccccuaucggcaacuguagcuccgagugcauuacccccaaugggucuaucccgaacgacaagccuuuccaaaauguuaacagaaucaccuauggagcuuguccccgguacgugaaacagaauacacuuaagcuggccacgggcaugcgcaacgugccugaaaaacagaccagagggauuuuuggagcgaucgccggcuucauugagaaugggugggaaggaauggucgauggcugguauggcuuucggcaccagaacagcgaggggacaggacaagcugccgaccucaaguccacccaggcugccaucgaucagauuaauggcaaacugaacagacuuaucgagaagacaaaugaaaaguuccaucaaaucgagaaagaguucagcgaaguggaagggcgcauucaggaccuggagaaguacguugaggauaccaaaaucgaccucuggucuuauaacgccggacugcugguggcucucgaaaaucagcacacgauugaucugacagacuccgagaugaacaaacuuuuugaacggaccagaaagcagcugcgcgagaacgcggaagauaugggcaaugggugcuucaagaucuaccauaagugugacaacgccugcauuggcagcauccggaauggaaccuacgaccacgaugucuauagagacgaggcucucaacaaucgcuuucaaauuaaaggcguggagcugaagucuggguacaaagauuggauccuuuggaucuccuucgccauuagcugcuuucugcucuguguugugcugcugggauucaucaugugggccugccagaagggcaacauucgguguaauaucugcauuuga

SEQ ID NO: 184008 - RNA, 1701 nt, Artificial Sequence
  derived and/or modified sequence opt5 from hemagglutinin__InfluenzaA__ABG37241
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuaugccugcaagcggggcucugucaauuccuuuuucagccgccucaacuggcugcacaaacuugaguacaaguaucccgcgcugaaugugaccaugccuaacaaugggaaauuugauaagcucuacauuuggggaguucaucacccgucuacagacuccgaucaaaccagccuguacgugagagccucuggcaaagucacgguguccacaaagcggagccagcagaccgugauccccgacauuggguaucgcccuugggucagaggacuguccucucggaucagcauuuacuggacaaucguuaagcccggcgacauucuccugaucaacuccaccgggaaccuuaucgcuccucgcggauauuucaaaauuagaaauggcaagagcucuaucaugcgguccgaugcccccauuggcaacuguagcucugagugcaucaccccgaaugggagcauuccuaacgacaaacccuuucagaaugugaaccgcaucacauacggagcuuguccuagauaugugaagcaaaauacgcugaaacucgccaccggcaugcggaacguccccgaaaagcagacacgcgggaucuucggagcgauugccggcuuuaucgagaaugggugggaaggaaugguggauggcugguacggcuucagacaccagaacuccgaggggaccggacaggcugccgaccugaaaucuacacaagcugccauugaucagaucaauggcaaacuuaaccggcugguugagaagaccaaugaaaaguuucaucagauugagaaggaguucagcgaaguggaagggagaauccaagaccucgagaaauaugucgaggauacgaagaucgaccugugguccuacaacgccgaacugcucguggcucuggagaaucagcacacaauugaucuuaccgacagcgaaaugaacaaacuguucgagcgcacccggaagcagcucagagaaaacgcggaggauaugggaaauggcugcuuuaagaucuaccauaaaugugacaacgccugcauugggucuauccgcaauggcacauaugaccacgauguuuaccgggacgaggcucugaacaauagauuccagauuaagggaguggaacuuaaauccggcuauaaggauuggauccuguggauuagcuuugccaucucuugcuuccuccugugugucgugcugcucggguuuaucaugugggccugccaaaaaggaaacauucgcuguaauaucugcauuuga

SEQ ID NO: 184009 - RNA, 1701 nt, Artificial Sequence
  derived and/or modified sequence opt5 from hemagglutinin__InfluenzaA__ABG37252
augaagaccaucauugcccugagcuacauccucugccugguguucgcucagaaacuuacaggcaacgacaauuccacggccacccugugucucgggcaccaugcgguccccaacggaacacugguuaagaccauuacaaaugaucaaaucgaggugaccaacgcuacagaacuugugcagucuagcccuaccggcagaauuugcgacuccccgcaccggauccuggaugggaaaaauuguacgcucaucgacgcccugcugggagauccccauugcgacggcuuucagaacaaggagugggaucucuucgucgaacgcucuaaagccuauagcaauuguuacccuuaugacgugcccgauuacgcuucccugagaucucuuguugccagcuccgggacccuggaguuuacaaacgaaaauuucaacuggaccggaguggcucaggacggcaagagcuaugccugcaagcggggcucugucaauuccuuuuucagccgccucaacuggcugcacaaacuugaguacaaguauccugcgcugaaugugacaaugcccaacaaugggaaauuugauaagcucuacauuuggggaguucaucacccuucuaccgacuccgaucaaacgagccuguacgugagagccucuggcaaagucacaguguccaccaagcggagccagcagacagugaucccggacauuggguaucgccccugggucagaggacuguccucucggaucagcauuuacuggaccaucguuaagccuggcgacauucuccugaucaacuccaccgggaaccuuaucgcuccccgcggauauuucaaaauuagaaauggcaagagcucuaucaugcgguccgaugccccuauuggcaacuguagcucugagugcaucacacccaaugggagcauuccgaacgacaaaccuuuucagaaugugaaccgcaucacguacggagcuugucccagauaugugaagcaaaauacccugaaacucgccacaggcaugcggaacgucccugaaaagcagacccgcgggaucuucggagcgauugccggcuuuaucgagaaugggugggaaggaaugguggauggcugguacggcuucagacaccagaacuccgaggggacaggacaggcugccgaccugaaaucuacccaagcugccauugaucagaucaauggcaaacuuaaccggcugguugagaagacgaaugaaaaguuucaucagauugagaaggaguucagcgaaguggaagggagaauccaagaccucgagaaauaugucgaggauacaaagaucgaccugugguccuacaacgccgaacugcucguggcucuggagaaucagcacaccauugaucuuaccgacagcgaaaugaacaaacuguucgagcgcacacggaagcagcucagagaaaacgcggaggauaugggaaauggcugcuuuaagaucuaccauaaaugugacaacgccugcauugggucuauccgcaauggcaccuaugaccacgauguuuaccgggacgaggcucugaacaauagauuccagauuaagggaguggaacuuaaauccggcuauaaggauuggauccuguggauuagcuuugccaucucuugcuuccuccugugugucgugcugcucggguuuaucaugugggccugccaaaaaggaaacauucgcuguaauaucugcauuuga

SEQ ID NO: 184010 - RNA, 1701 nt, Artificial Sequence
  derived and/or modified sequence opt5 from hemagglutinin__InfluenzaA__ABG37263
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucggcaauuguaacagcgagugcauuacccccaauggguccaucccgaacgacaaaccuuuucaaaaugugaaccgcaucacauauggagcuugucccagauacgugaagcagaauacgcuuaaacuggccaccggcaugcggaacgucccugaaaagcagacacgcgggauuuucggagcgaucgccggcuuuauugagaaugggugggaaggaaugguggauggcugguauggcuucagacaccagaacucugaggggaccggacaagcugccgaccucaaaagcacacaggcugccaucgaucagauuaauggcaagcugaaccggcuuaucgagaagaccaaugaaaaauuucaucaaaucgagaaggaguucuccgaaguugaagggcgcauucaggaccuggagaaauacguggaggauacgaagaucgaccucuggagcuauaacgccgaacugcuggucgcucucgagaaucagcacacaauugaucugaccgacucugaaaugaacaaacuuuucgagagaacccggaagcagcugagagaaaacgcggaggauaugggaaauggcugcuuuaagaucuaccauaaaugugacaacacaugcauuggguccauccgcaauggcaccuacgaccacgauguguaucgggacgaggcccucaacaauagauuccaaauuaagggaguugaacugaaaagcggcuacaaggauuggauccuuuggaucucuuuugcuauuuccugcuuccugcucugugugguccugcugggguuuaucaugugggccugccagaaaggaaacauucgcuguaauaucugcauuuga

SEQ ID NO: 184011 - RNA, 1701 nt, Artificial Sequence
  derived and/or modified sequence opt5 from hemagglutinin__InfluenzaA__ABG37274
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuaugccugcaagcggggcucugucaauuccuuuuucagccgccucaacuggcugcacaaacuugaguacaaguaucccgcgcugaaugugaccaugccuaacaaugggaaauuugauaagcucuacauuuggggaguucaucacccgucuacagacuccgaucaaaucagccuguacgugagagccucuggcaaagucaccguguccacgaagcggagccagcagacagugauucccgacaucggguaucgcccuugggucagaggacuguccucucggauuagcaucuacuggaccauuguuaagcccggcgacauccuccugaucuccagcacagggaaccuuauugcuccucgcggauauuucaaaaucagaaacggcaagucuuccauuaugcggagcgaugcccccaucggcaauuguucuagcgagugcauuaccccgaacggguccaucccuaaugacaaacccuuucagaacgugaaucgcaucaccuacggagcuuguccuagauaugugaagcaaaacacacugaaacucgccacgggcaugcggaauguccccgaaaagcagacccgcgggauuuucggagcgaucgccggcuuuauugagaacgggugggaaggaaugguggauggcugguacggcuucagacaccaaaauucugaggggacaggacaggcugccgaccugaaaagcacccaggcugccaucgaucagauuaacggcaaacuuaaucggcugguugagaagacaaacgaaaaguuucaucagaucgagaaggaguucuccgaaguggaagggagaauccaagaccucgagaaauaugucgaggauaccaagauugaccuguggagcuacaaugccgaacugcucguggcucuggagaaccagcacacgaucgaucuuacagacucugaaaugaauaaacuguucgagcgcacccggaagcagcucagagaaaacgcggaggauaugggaaacggcugcuuuaagauuuaccauaaaugugacaaugccugcaucggguccauucgcaacggcaccuaugaccacgauguuuaccgggacgaggcucugaauaacagauuccagaucaagggaguggaacuuaaaagcggcuauaaggauuggauucuguggaucucuuuugccaucuccugcuuccuccugugugucgugcugcucggguuuauuaugugggccugccaaaaaggaaauauccgcuguaacauuugcaucuga

SEQ ID NO: 184012 - RNA, 1701 nt, Artificial Sequence
  derived and/or modified sequence opt5 from hemagglutinin__InfluenzaA__ABG37285
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuaugccugcaagcggggcucugucaauuccuuuuucagccgccucaacuggcugcacaaacuugauuacaaguaucccgcgcugaaugugaccaugccuaacaaugggaaauuugacaagcucuacauuuggggaguucaucacccgucuacagauuccgaccaaaccagccuguacgugagagccucuggcaaagucacgguguccacaaagcggagccagcagaccgugauccccgacauuggguaucgcccuugggucagaggacuguccucucggaucagcauuuacuggacaaucguuaagcccggcgauauucuccugaucaacuccaccgggaaccuuaucgcuccucgcggauauuucaaaauuagaaauggcaagagcucuaucaugcgguccgacgcccccauuggcaacuguagcucugagugcaucaccccgaaugggagcauuccuaacgauaaacccuuucagaaugugaaccgcaucacauacggagcuuguccuagauaugugaagcaaaauacgcugaaacucgccaccggcaugcggaacguccccgagaagcagacacgcgggaucuucggagcgauugccggcuuuaucgaaaaugggugggagggaaugguggacggcugguacggcuucagacaccagaacuccgaagggaccggacaggcugccgaucugaaaucuacacaagcugccauugaccagaucaauggcaaacuuaaccggcugguugagaagaccaaugagaaguuucaucagauugaaaaggaguucagcgaaguggaggggagaauccaagaucucgaaaaauaugucgaggacacgaagaucgaucugugguccuacaacgccgagcugcucguggcucuggaaaaucagcacacaauugaccuuaccgauagcgagaugaacaaacuguucgaacgcacccggaagcagcucagagagaacgcggaagacaugggaaauggcugcuuuaagaucuaccauaaaugugacaacgccugcauugggucuauccgcaauggcacauaugaucacgacguuuaccgggaugaggcucugaacaauagauuccagauuaagggaguggagcuuaaauccggcuauaaggacuggauccuguggauuagcuuugccaucucuugcuuccuccuguguuuuguccugcucggguucaucaugugggccugccaaaaaggaaacauucgcuguaauaucugcauuuga

SEQ ID NO: 184013 - RNA, 1701 nt, Artificial Sequence
  derived and/or modified sequence opt5 from hemagglutinin__InfluenzaA__ABG37296
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucggcaauuguaacagcgagugcauuacccccaauggguccaucccgaacgacaaaccuuuucaaaaugugaaccgcaucacauauggagcuugucccagauacgugaagcagaauacgcuuaaacuggccaccggcaugcggaacgucccugaaaagcagacacgcgggauuuucggagcgaucgccggcuuuauugagaaugggugggaaggaaugguggauggcugguauggcuucagacaccagaacucugaggggaccggacaagcugccgaccucaaaagcacacaggcugccaucgaucagauuaauggcaagcugaaccggcuuaucgagaagaccaaugaaaaauuucaucaaaucgagaaggaguucuccgaaguugaagggcgcauucaggaccuggagaaauacguggaggauacgaagaucgaccucuggagcuauaacgccgaacugcuggucgcucucgagaaucagcacacaauugaucugaccgacucugaaaugaacaaacuuuucgagagaacccggaagcagcugagagaaaacgcggaggauaugggaaauggcugcuuuaagaucuaccauaaaugugacaacgccugcauuggguccauccgcaauggcacauacgaccacgauguguaucgggacgaggcucucaacaauagauuccaaauuaagggaguugaacugaaaagcggcuacaaggauuggauccuuuggaucucuuuugccauuuccugcuuccugcucugugugguccugcugggguuuaucaugugggccugccagaaaggaaacauucgcuguaauaucugcauuuga

SEQ ID NO: 184014 - RNA, 1701 nt, Artificial Sequence; identical to SEQ ID NO: 184008
  derived and/or modified sequence opt5 from hemagglutinin__InfluenzaA__ABG37307

SEQ ID NO: 184015 - RNA, 1701 nt, Artificial Sequence; identical to SEQ ID NO: 184013
  derived and/or modified sequence opt5 from hemagglutinin__InfluenzaA__ABG37318

SEQ ID NO: 184016 - RNA, 1701 nt, Artificial Sequence
  derived and/or modified sequence opt5 from hemagglutinin__InfluenzaA__ABG37329
augaagaccaucauugcccugagcuacauccucugccugguguucgcucagaaacuucccgagaacgacaauuccacagccacgcugugucucggccaccaugcggucccuaacgggacccugguuaagacaauuaccaaugaucaaaucgaagugacaaacgcuaccgagcuugugcagucuagcccgacaggaagaauuugcgacucuccccaccggauccuggauggcaaaaauuguacccucaucgacgcccugcugggggauccucauugcgacggauuucagaacaaggaaugggaucucuucgucgagcgcuccaaagccuauagcaauuguuaccccuaugacgugccugauuacgcuucccugagaucucuuguugccagcuccggcacgcuggaauuuaccaacgagaauuucaacuggacagggguggcucaggacggaaagagcuaugccugcaagcggggcucugucaauuccuuuuucagccgccucaacuggcugcacaaacuugaguacaaguaucccgcgcugaaugugaccaugccuaacaauggcaaauuugauaagcucuacauuuggggaguucaucacccgucuacagacuccgaucaaaccagccuguacgugagagccucugggaaagucacgguguccacaaagcggagccagcagaccgugauccccgacauuggcuaucgcccuugggucagagggcuguccucucggaucagcauuuacuggacaaucguuaagcccggagacauucuccugaucaacuccaccggcaaccuuaucgcuccucgcggguauuucaaaauuagaaauggaaagagcucuaucaugcgguccgaugcccccauuggcaacuguagcucugaaugcaucaccccgaauggcagcauuccuaacgacaaacccuuucagaaugugaaccgcaucacauacggggcuuguccuagauaugugaagcaaaauacgcugaaacucgccaccggaaugcggaacguccccgagaagcagacacgcggcaucuucggggcgauugccggauuuaucgaaaauggcugggaggggaugguggauggaugguacggcuucagacaccagaacuccgagggcaccgggcaggcugccgaccugaaaucuacacaagcugccauugaucagaucaauggaaaacuuaaccggcugguugaaaagaccaaugagaaguuucaucagauugaaaaggaguucagcgaaguggagggcagaauccaagaccucgagaaauaugucgaagauacgaagaucgaccugugguccuacaacgccgagcugcucguggcucuggaaaaucagcacacaauugaucuuaccgacagcgagaugaacaaacuguucgaacgcacccggaagcagcucagagagaacgcggaggauauggggaauggaugcuuuaagaucuaccauaaaugugacaacgccugcauuggcucuauccgcaaugggacauaugaccacgauguuuaccgggacgaagcucugaacaauagauuccagauuaagggcguggagcuuaaauccggauauaaggauuggauccuguggauuagcuuugccaucucuugcuuccuccugugugucgugcugcucggcuuuaucaugugggccugccaaaaagggaacauucgcuguaauaucugcauuuga

SEQ ID NO: 184017 - RNA, 1701 nt, Artificial Sequence
  derived and/or modified sequence opt5 from hemagglutinin__InfluenzaA__ABG37340
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuuuuccgacaggcagaauuugcgacagcccccaccggauccuggaugggaaaaauuguacccucaucgacgcccugcugggagauccucauugcgacggcuuccagaacaaggagugggaucucuuugucgaacgcuccaaagccuauucuaauuguuaccccuaugacgugccugauuacgcuagccugagaucccuuguugccucuagcgggacgcuggaguucaccaacgaaaauuuuaacuggacaggaguggcucaggacggcaaguccuauagcugcaagcggggcucugucaauuccuucuuuagccgccucaacuggcugcacaaacuugaguacaaguaucccgcccugaaugugaccaugccuaacaaugggaaauucgauaagcucuacauuuggggaguucaucacccgucuacagacuccgaucaaaccagccuguacgugagagcgucuggcaaagucacgguguccacaaagcggagccagcagaccgugauccccgacauuggguaucgcccuugggucagaggacuguccucucggaucagcauuuacuggacaaucguuaagcccggcgacauucuccugaucaacuccaccgggaaccuuaucgccccucgcggauauuuuaaaauuagaaauggcaagagcucuaucaugcgguccgaugcucccauuggcaacuguagcucugagugcaucaccccgaaugggagcauuccuaacgacaaacccuuccagaaugugaaccgcaucacauacggagccuguccuagauaugugaagcaaaauacgcugaaacucgcuaccggcaugcggaacguccccgaaaagcagacacgcgggaucuuuggagccauugcgggcuucaucgagaaugggugggaaggaaugguggauggcugguacggcuuuagacaccagaacuccgaggggaccggacaggccgcugaccugaaaucuacacaagccgcuauugaucagaucaauggcaaacuuaaccggcugguugagaagaccaaugaaaaguuccaucagauugagaaggaguucagcgaaguggaagggagaauccaagaccucgagaaauaugucgaggauacgaagaucgaccugugguccuacaacgccgaacugcucguggcccuggagaaucagcacacaauugaucuuaccgacagcgaaaugaacaaacuguuugagcgcacccggaagcagcucagagaaaacgcugaggauaugggaaauggcugcuucaagaucuaccauaaaugugacaacgcgugcauugggucuauccgcaauggcacauaugaccacgauguuuaccgggacgaggcccugaacaauagauuucagauuaagggaguggaacuuaaauccggcuauaaggauuggauccuguggauuagcuucgcuaucucuugcuuucuccugugugucgugcugcucggguucaucaugugggccugccaaaaaggaaacauucgcuguaauaucugcauuuga

SEQ ID NO: 184018 - RNA, 1701 nt, Artificial Sequence
  derived and/or modified sequence opt5 from hemagglutinin__InfluenzaA__ABG37351
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucgauagcacagggaaccuuauugcucccagaggauacuuuaagauccggaacggcaaaucuuccauuaugcgcagcgacgccccuaucggcaauuguucuagcgagugcauuacccccaacggguccaucccgaaugauaagccuuuccagaacgugaauagaaucaccuauggagcuuguccccgguacgugaaacaaaacacacugaagcucgccacgggcaugcgcaaugucccugaaaaacagaccagagggauuuuuggagcgaucgccggcuucauugagaacgggugggaaggaaugguggacggcugguauggcuuucggcaccagaauagcgaggggacaggacaggcugccgaucugaagucuacccaagcugccaucgaccagauuaacggcaaacuuaauagacugaucgagaagacaaacgaaaaguuccaucagaucgagaaagaguucuccgaaguugaagggcgcauucaagaucucgagaaguacguggaggacaccaaaaucgaucuguggagcuauaaugccggacugcucgucgcucuggaaaaccagcacacgauugaccuuacagauucugagaugaauaagcuguuugaacggaccagaaaacagcuccgcgagaacgcggaagacaugggcaacgggugcuucaagaucuaccauaagugugacaaugccugcauuggcuccauccggaacggaaccuacgaucacgacguguauagagaugaggcucugaauaaccgcuuucagauuaaaggcguugagcuuaagagcggguacaaagacuggauccuguggaucucuuucgccauuuccugcuuucuccugugugugguccugcucggauucaucaugugggccugccaaaagggcaauauucgguguaacaucugcauuuga

SEQ ID NO: 184019 - RNA, 1698 nt, Artificial Sequence
  derived and/or modified sequence opt5 from hemagglutinin__InfluenzaA__ABG37362
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuugguaugcuuucgcccuguccagaggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcggucugccaagcugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagcgcagaauggaaaaccucaacaagaagguggaugacggauuccuggauauuuggacauauaaugcggagcuucugguccuccuggaaaacgagcggacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaaucgcgagaaaauugacggaguuaagcuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 184020 - RNA, 1698 nt, Artificial Sequence; identical to SEQ ID NO: 183824
  derived and/or modified sequence opt5 from hemagglutinin__InfluenzaA__ABG37384

SEQ ID NO: 184021 - RNA, 1698 nt, Artificial Sequence; identical to SEQ ID NO: 183894
  derived and/or modified sequence opt5 from hemagglutinin__InfluenzaA__ABG37395

SEQ ID NO: 184022 - RNA, 1701 nt, Artificial Sequence; identical to SEQ ID NO: 183801
  derived and/or modified sequence opt5 from hemagglutinin__InfluenzaA__ABG37406

SEQ ID NO: 184023 - RNA, 1701 nt, Artificial Sequence
  derived and/or modified sequence opt5 from hemagglutinin__InfluenzaA__ABG37428
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaagucucaucagaucgaaaaagaguuuuccgaaguggagggccgcauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgggagaaugcggaggauauggggaacggaugcuucaagaucuaucauaaaugugacaaugccugcauuggcuccaucagaaacgggaccuacgaucacgacgucuaccgcgacgaagcucucaauaaccgguuucagauuaagggcguggagcugaaaagcggauauaaggauuggguucuuuggaucuccuucgccaucucuugcuuucugcucuguauugugcugcugggcuucaucaugugggccugccagaaagggaauauuagauguaacaucugcauuuga

SEQ ID NO: 184024 - RNA, 1701 nt, Artificial Sequence; identical to SEQ ID NO: 183586
  derived and/or modified sequence opt5 from hemagglutinin__InfluenzaA__ABG37439

SEQ ID NO: 184025 - RNA, 1701 nt, Artificial Sequence; identical to SEQ ID NO: 183664
  derived and/or modified sequence opt5 from hemagglutinin__InfluenzaA__ABG37461

SEQ ID NO: 184026 - RNA, 1701 nt, Artificial Sequence
  derived and/or modified sequence opt5 from hemagglutinin__InfluenzaA__ABG37472
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagguccuggauggggagaauuguacccucaucgacgcccugcugggagauccccauugcgacggcuuucagaacaaagaaugggaucucuucguggagcggagcaaggccuauuccaauuguuacccuuaugacguucccgauuacgugucucugcgcagccuugucgcuuccagcgggacgcuggaauuuaacaaugagucuuucaacuggaccggaguggcccaaaauggcacauccagcgcuugcaaaagacggucugacaaguccuuuuucagccgccucaacuggcugcaccagcuuaaguauaaauacccugcccugaauguuaccaugcccaacaaugagaaguuugauaaacucuauaucuggggcgugcaucacccugggacagacucugaucagauuucccuguacgcgcaggccagcggaagagucaccguguccacgaagcggucucaacagacagugaucccgaacauuggcagccgccccugggucagagggguuuccagccggaucucuauuuacuggaccaucgugaaaccuggagacauucugcucaucaacuccacaggcaaucugaucgcuccccgcggguauuucaagauuagaagcggaaagucuagcaucaugcgguccgacgccccuauuggcaaauguaacucugaaugcaucacccccaauggcagcauuccgaacgauaagccuuuucagaaugugaaccgcaucaccuacgggcccuguccuagauaugucaaacagaauacacuuaagcuggcuacgggaaugcggaacgugcccgagaaacaaacccgcggcaucuucggggccauugcgggauuuaucgaaaauggcugggaggggaugauggacggaugguacggcuucagacaccagaacuccgagggcacagggcaggccgcugaucucaagagcacccaagccgcuauuaaucagaucaacggaaaacugaaucggcuuauugaaaagacaaacgagaaguuucaucagaucgaaaaagaguucucugaaguugagggcagaauccaggaccuggagaaguauguggaagauaccaaaauugaccucugguccuacaaugccgagcugcuggucgcccucgaaaaccaacacacgaucgaucugacagacagcgagaugaacaaacuuuucgaacgcaccaagaagcagcugcgggagaaugcugaggauauggggaacggaugcuuuaagauuuaucauaaaugugacaaugcgugcaucggcucuauuagaaacgggaccuacgaucacgacguguaccgcgacgaagcccucaauaaccgguuccagaucaagggcguugagcugaaauccggauauaaggauuggauucuuuggaucagcuuugcuaucuccugcuuccugcucuguauugugcugcugggcuuuaucaugugggccugccagaaagggaauauuagauguaacaucugcauuuga

SEQ ID NO: 184027 - RNA, 1701 nt, Artificial Sequence; identical to SEQ ID NO: 183586
  derived and/or modified sequence opt5 from hemagglutinin__InfluenzaA__ABG37483

SEQ ID NO: 184028 - RNA, 1701 nt, Artificial Sequence; identical to SEQ ID NO: 183664
  derived and/or modified sequence opt5 from hemagglutinin__InfluenzaA__ABG37494

SEQ ID NO: 184029 - RNA, 1701 nt, Artificial Sequence
  derived and/or modified sequence opt5 from hemagglutinin__InfluenzaA__ABG37505
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacccuggaauuuaacaaugagucuuucaacuggacgggagucgcccaaaauggcaccuccagcgcuugcaaaagacggucugacaaguccuuuuucagccgccucaacuggcugcaccagcuuaaguauaaauacccugcccugaaugugacaaugcccaacaaugagaaguuugauaaacucuauauuuggggcguucaucacccugggaccgacucugaucagaucucccuguacgcgcaggccagcggaagagugacagucuccaccaagcggucucaacagacggugauuccgaacaucggcagccgccccugggugagaggggucuccagccggauuucuaucuacuggacaauuguuaaaccuggagacauccugcucaucaacuccaccggcaaucugauugcuccccgcggguauuucaagaucagaagcggaaagucuagcauuaugcgguccgacgccccuaucgauaaauguaacucugaaugcauuacacccaauggcagcaucccgaacgacaagccuuuucagaaugugaaccgcaucaccuacggccuuugucccagauaugugaaacagaauacccugaagcucgcuacagggaugcggaacgucccugagaaacaaacgcgcggaauuuucggcgccaucgcgggguuuauugaaaauggaugggagggcaugauggaugggugguacggauucagacaccagaacuccgagggcaccggccaggccgcugaccugaaaagcacacaagccgcuaucaaucagauuaacgggaaacuuaaucggcugaucgaaaagaccaacgagaaguuucaucagaucgaaaaagaguucucugaaguggagggacgcauucaggaucucgagaaguauguugaagacacaaaaaucgaucugugguccuacaaugccgagcugcucguggcccuggaaaaccaacacaccauugaccuuacggauagcgagaugaacaagcuguucgaaagaacaaagaagcagcuccgggagaaugcugaggacaugggcaacgggugcuuuaagaucuaucauaaaugugauaaugcgugcauuggaucuaucagaaacggcaccuacgaccacgacgucuaccgcgaugaagcccugaauaaccgguuccagauuaaggggguggagcuuaaauccggcuauaaggacuggauccuguggaucagcuuugcuauuuccugcuuccuccuguguaucguucugcucggauuuauuaugugggccugccagaaaggcaauaucagauguaacauuugcaucuga

SEQ ID NO: 184030 - RNA, 1701 nt, Artificial Sequence; identical to SEQ ID NO: 183540
  derived and/or modified sequence opt5 from hemagglutinin__InfluenzaA__ABG37516

SEQ ID NO: 184031 - RNA, 1701 nt, Artificial Sequence; identical to SEQ ID NO: 183540
  derived and/or modified sequence opt5 from hemagglutinin__InfluenzaA__ABG37527

SEQ ID NO: 184032 - RNA, 1701 nt, Artificial Sequence; identical to SEQ ID NO: 183540
  derived and/or modified sequence opt5 from hemagglutinin__InfluenzaA__ABG37538

SEQ ID NO: 184033 - RNA, 1701 nt, Artificial Sequence; identical to SEQ ID NO: 183540
  derived and/or modified sequence opt5 from hemagglutinin__InfluenzaA__ABG37549

SEQ ID NO: 184034 - RNA, 1701 nt, Artificial Sequence; identical to SEQ ID NO: 183540
  derived and/or modified sequence opt5 from hemagglutinin__InfluenzaA__ABG37560

SEQ ID NO: 184035 - RNA, 1701 nt, Artificial Sequence; identical to SEQ ID NO: 183540
  derived and/or modified sequence opt5 from hemagglutinin__InfluenzaA__ABG37571

SEQ ID NO: 184036 - RNA, 1701 nt, Artificial Sequence
  derived and/or modified sequence opt5 from hemagglutinin__InfluenzaA__ABG37582
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgaucaugcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaccugaaauacaaguauccugcccuuaaugucaccaugcccaacaaugagaaauuugauaagcuguacauuuggggagugcaucacccugggacggacagcgaucagaucucucucuaugcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguacuucaagauuagauccggaaaaagcucuaucaugcggagcgaugccccuaucggcaaguguaacuccgagugcauuacacccaauggcucuaucccgaacgacaaaccuuuucagaaugucaaccgcauuacguauggggcuugucccagauacguuaagcagaauacccugaaacuugccacaggaaugcggaacgugccugaaaagcaaacccgcggcaucuucggggcgauugccggauuuaucgagaauggcugggaagggaugguggauggaugguauggcuucagacaccagaacagcgagggcacagggcaggcugccgaccugaaauccacccaagcugccaucaaucagauuaacggaaagcucaaucggcugaucggcaagacgaacgagaaauuucaucagauugaaaaggaguucagcgaagucgaggggagaauccaggaucuugaaaaauacguggaggacacaaagauugaucuguggucuuauaaugccgagcuccugguugcucuggaaaaccaacacaccaucgaccucaccgauuccgagaugaacaaacuguucgaacgcacaaagaagcagcuucgggagaaugcggaagacaugggaaacggcugcuuuaaaauuuaccauaagugugauaaugccugcaucgggagcaucagaaacggcaccuaugaccacgacguguaccgcgaugaggcucugaauaaccgguuccagauuaaaggagucgagcucaagucuggcuacaaagacuggauccuguggauuuccuuugccaucagcugcuuccuucuguguguggcccuccugggguuuauuaugugggcuugccagaagggaaauaucagauguaacaucugcauuuga

SEQ ID NO: 184037 - RNA, 1701 nt, Artificial Sequence; identical to SEQ ID NO: 183540
  derived and/or modified sequence opt5 from hemagglutinin__InfluenzaA__ABG37604

SEQ ID NO: 184038 - RNA, 1701 nt, Artificial Sequence; identical to SEQ ID NO: 183540
  derived and/or modified sequence opt5 from hemagglutinin__InfluenzaA__ABG37615

SEQ ID NO: 184039 - RNA, 1698 nt, Artificial Sequence; identical to SEQ ID NO: 183766
  derived and/or modified sequence opt5 from hemagglutinin__InfluenzaA__ABG47807

SEQ ID NO: 184040 - RNA, 1698 nt, Artificial Sequence; identical to SEQ ID NO: 183765
  derived and/or modified sequence opt5 from hemagglutinin__InfluenzaA__ABG47818

SEQ ID NO: 184041 - RNA, 1701 nt, Artificial Sequence
  derived and/or modified sequence opt5 from hemagglutinin__InfluenzaA__ABG47829
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccaaucugucuaaguccuacgugaacaauaaagagaaggaaguucucgugcuguggggaguccaucacccuagcaacauuggggaucagagagccaucuaccacaccgagaacgcguauguguccguggucucuagccauuacucccggcgcuuuacgccggaaaucacaaagagacccaaaguucggaaucaggagggccgcauuaacuauuacuggacccugcucgagccuggggacacaaucauuuucgaagccaauggaaaccugaucgcucccugguaugccuuugcucuuagcagaggcuucgggucuggaauuaucaccuccaaugccagcaugggcgagugugaugcgaagugccagaccccucaaggcgccauuaacucuagccugcccuuucagaaugugcacccggugacaaucggggaauguccuaaauacguccgguccacgaagcuccgcauggugaccggacugagaaacauccccucuauucagagccggggccuuuucggggcuaucgccggauuuauugagggcggguggacaggaaugaucgacggcugguauggcuaccaucaccagaaugaacaaggguccggauacgcugccgaucagaaaagcacccagaacgccauugacggcaucacaaauaagguuaacucugugaucgagaaaaugaauacccaguucacggcugucgggaaggaguucaacaagcuggaacgcagaauggagaaucucaacaaaaagguggaugacggauuucuggauauuuggacauauaacgcggaacugcucguucugcuugagaaugaacggacccuggacuuccacgacuccaacgugaaaaaucucuacgagaaggucaaaacccaacugaagaacaaugccaaggagaucggcaacgggugcuuugaguucuaucauaaauguaauaacgaaugcauggaaagcgugaagaauggcacauacgauuauccuaaauacucugaggaguccaaacuuaaccgcgagaaaauugacggagucaagcuggaaagcaugggcguguaucagauccucgcuauuuacuccaccguugccucuagccuggugcugcucgucucccugggggccaucucuuuuuggaugugcagcaauggaucccuucaguguagaaucugcauuuga

SEQ ID NO: 184042 - RNA, 1701 nt, Artificial Sequence
  derived and/or modified sequence opt5 from hemagglutinin__InfluenzaA__ABG47840
augaaggugaaacugcucguccugcuuugcgccuucaccgcuacauacgccgacacgaucuguauuggcuaucacgcgaacaauagcaccgauacaguugacaccgugcuggagaagaacgugacagucacccauuccgugaaucuccuggaagauucucacaacgggaaacuuugcagacugaagggaacagcuccccuccagcugggcaauuguagcguugccggguggauccugggaaacccugagugcgaaucccucuuuucuaaagagagcugguccuacauugccgaaaccccgaaucccgagaacggcacguguuauccuggguacuucgcugacuaugaggaacugcgggagcaacuuucuagcguguccagcuuugaacgcuucgagaucuuucccaaggagucuuccuggccuaaucauaccgucacaaagggagugaccgccagcugcucucacaacggcaaauccagcuucuacaagaaucugcucuggcugacagaaaagaacggccuuuaucccaaucugucuaaguccuacguuaacaauaaagagaaggaagugcucguccuguggggagugcaucacccuagcaacauuggggaucagagagcuaucuaccacaccgagaacgccuauguguccgucguuucuagccauuacucccggcgcuuuacgccggaaaucgcgaagagacccaaagugcgggaccaggagggccgcauuaauuauuacuggacacugcucgagccuggggauaccaucauuuucgaagccaacggaaaucugaucgcucccugguaugccuuugcucuuagcagaggcuucgggucuggaauuaucacauccaacgccagcaugucugagugugacgcgaagugccagaccccucaaggcgccauuaauagcucccugcccuuucagaacgugcacccggucaccaucggcgaauguccuaaauacgugcggucuacaaagcuccgcaugguuacggggcugagaaauauccccagcauucagucccggggacuuuucggcgcuaucgccggguuuauugagggaggcuggaccgggaugaucgauggaugguauggcuaccaucaccagaacgaacaaggcagcggguacgcugccgaccagaaaucuacacagaaugccauugauggaaucaccaacaaggucaauuccgugaucgagaaaaugaacacacaguucaccgcugugggcaaggaguucaauaagcuggaacgcagaauggagaaccucaauaaaaagguugacgauggguuucuggacauuuggacguauaacgcggaacugcucgugcugcuugagaacgaacggacacuggacuuccacgauagcaaugucaaaaaccucuacgagaaggugaaaaaucaacugaagaacaaugccaaggagaucggaaacggcugcuuugaguucuaucauaaauguaauaacgaaugcauggaaucugucaagaaugggaccuacgacuauccuaaauacuccgaggagagcaaacuuaaccgcgagaaaauugauggcgugaagcuggaauccaugggaguuuaucagauccucgcuauuuacucuaccguggccagcucccugguccugcucgugucucugggcgccaucagcuuuuggaugugcuccaaugggagccuucaguguagaaucugcauuuga

SEQ ID NO: 184043 - RNA, 1701 nt, Artificial Sequence
  derived and/or modified sequence opt5 from hemagglutinin__InfluenzaA__ABG47851
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaacagcuuuuucucucgccucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccggcagagucacggugagcacaaaacggucccagcagaccgugaucccgaauauugggucucgccccugggucagaggaaucagcucccggauuagcaucuauuggacaauuguuaagccuggcgacauccugcucaucaacucuaccgggaaccugauugcuccccgcggauacuucaagaucagaaauggcaaauccagcauuaugcggucugaugccccuaucgacaacuguaauagcgagugcauuacccccaacggcuccaucccgaaugauaagccuuuucaaaacgugaaucgcaucacauauggggcuugucccagauacgugaaacagaacacgcuuaagcuggccaccggaaugcggaaugucccugaaaaacagacacgcggcauuuucggggcgaucgccggauuuauugagaacggcugggaagggaugguggacggaugguauggcuucagacaccaaaauucugagggcaccgggcaggcugccgaucucaagagcacacaggcugccaucgaccagauuaacggaaaacugaaucggcuuaucgagaagaccaacgaaaaguuucaucaaaucgagaaagaguucuccgaaguugaaggccgcauucaggaucuggagaaguacguggaggacacgaaaaucgaucucuggagcuauaaugccgaacugcuggucgcucucgagaaccagcacacaauugaccugaccgauucugaaaugaacaagcuguucgagagaacccggaaacagcugagagaaaaugcggaggacauggggaacggaugcuuuaagaucuaccauaagugugacaaugccugcauuggcuccauccgcaacgggacauacaaucacgauguguaucgggacgaggcucucaacaauagauuccaaauuaaaggcguugaacuuaagagcggauacaaagauuggauccuuuggaucucuuuugccauuuccugcuuccugcucugugugguccugcugggcuuuaucaugugggccugccagaaggggaacauucgcuguagcaucugcauuuga

SEQ ID NO: 184044 - RNA, 1701 nt, Artificial Sequence
  derived and/or modified sequence opt5 from hemagglutinin__InfluenzaA__ABG47862
augagaaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggccggauuugcaauucuccgcaccgcauccuggacgggaagaacuguacccucaucgaugcccugcugggagacccccauugcgauggcuuucagaauaaagagugggaccucuucgucgaaagaagcaaggccuauuccaacuguuacccuuaugaugugcccgacuacgcuucucugcggagccuuauugccuccagcgggacgcuggaguuuaccaaugaaggauucaacuggacaggcguugcucaggauggcaccucuuaugccugcaaacgcggguccgucaagagcuuuuucucuagacucaauuggcugcacaaacuugaguacaaguauccugcgcugaacgugacaaugcccaauaacgacaaguuugauaaacucuacaucuggggagugcaucacccuuccaccgacagcgaucaaacgucucuguacguucaggccuccggccgggugacagucagcaccaagcgcucccagcagacagugauuccgaauaucgggucuagacccugggugcggggagucagcucccgcauuagcaucuauuggaccauuguuaaaccuggcgacauccugcucaucaacucuaccgggaaccugauugcucccagaggauacuucaagauccgguccggcaagagcucuauuaugcgcagcgacgccccuaucggcaauuguaacuccgagugcauuacacccaaugggucuaucccgaacgauaaaccuuuucaaaaugugaacagaaucacguauggagcuuguccccgguacgugaagcagaauacccuuaaacuggccacaggcaugcgcaacgucccugaaaagcagaccagagggauuuucggagcgaucgccggcuuuauugagaaugggugggaaggaaugguggacggcugguauggcuuccggcaccagaacagcgaggggacaggacaagcugccgaucucaaauccacccaggcugccaucaaucagauuaacggcaagcugaauagacuuaucgagaaaacgaacgaaaaguuucaucaaaucgagaaggaguucagcgaaguugaagggcgcauucaggaccuggagaaauacguggaggauacaaagaucgaccucuggucuuauaaugccgaacugcuggucgcucucgagaaccagcacaccauugaucugaccgacuccgaaaugaacaaacuuuucgagcggacaagaaagcagcugcgcgaaaaugcggaggauaugggaaacggcugcuuuaaaaucuaccauaagugugacaaugccugcauugggagcauccggaacggcaccuacgaucacgacguguauagagacgaggcucucaauaaccgcuuccaaauuaagggaguugaacugaaaucuggcuacaaggauuggauccuuuggaucuccuuugccauuagcugcuuccugcucugugugguccugcugggguuuaucaugugggccugccagaaaggaaauauucgguguaacaucugcauuuga

SEQ ID NO: 184045 - RNA, 1701 nt, Artificial Sequence; identical to SEQ ID NO: 184008
  derived and/or modified sequence opt5 from hemagglutinin__InfluenzaA__ABG47873

SEQ ID NO: 184046 - RNA, 1701 nt, Artificial Sequence; identical to SEQ ID NO: 184013
  derived and/or modified sequence opt5 from hemagglutinin__InfluenzaA__ABG47895

SEQ ID NO: 184047 - RNA, 1701 nt, Artificial Sequence; identical to SEQ ID NO: 184008
  derived and/or modified sequence opt5 from hemagglutinin__InfluenzaA__ABG47906

SEQ ID NO: 184048 - RNA, 1701 nt, Artificial Sequence
  derived and/or modified sequence opt5 from hemagglutinin__InfluenzaA__ABG47917
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucgaucagauuaauggcaaacugaacagacugaucgagaagacaaaugaaaaguuccaucagaucgagaaagaguucuccgaaguugaagggcgcauucaagaccucgagaaguacguggaggauaccaaaaucgaccuguggagcuauaacgccggacugcucgucgcucuggaaaaucagcacacgauugaucuuacagacucugagaugaacaagcuguuugaacggaccagaaaacagcuccgcgagaacgcggaagauaugggcaaugggugcuucaagaucuaccauaagugugacaacgccugcauuggcuccauccggaauggaaccuacgaccacgauguguauagagacgaggcucugaacaaucgcuuucagauuaaaggcguugagcuuaagagcggguacaaagauuggauccuguggaucucuuucgccauuuccugcuuucuccugugugugguccugcucggauucaucaugugggccugccaaaagggcaacauucgguguaauaucugcauuuga

SEQ ID NO: 184049 - RNA, 1701 nt, Artificial Sequence; identical to SEQ ID NO: 184048
  derived and/or modified sequence opt5 from hemagglutinin__InfluenzaA__ABG47928

SEQ ID NO: 184050 - RNA, 1701 nt, Artificial Sequence
  derived and/or modified sequence opt5 from hemagglutinin__InfluenzaA__ABG47939
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccguaucggauccuggaugggaaaaauuguacccucaucgacgcccugcugggagauccccacugcgacggcuuucagaacaaggagugggaucucuucgucgaacgcagcaaagccuacuccaauuguuauccuuacgacgugcccgauuaugcuucucugagaagccuuguugccuccagcgggacgcuggaguuuauuaacgaagacuucaauuggaccggaguggcucaggauggcaagucuuacgccugcaagcggggcuccgucaacagcuuuuucucucgccucaauuggcugcauaaacuugaguauaaguacccugcgcugaacgugacaaugcccaauaacgggaaauuugacaagcucuacaucuggggaguucaccauccuuccaccgauagcgaccaaacaucucuguaugugagagccuccggccgggucaccgugagcacgaaacgcucccagcagacagugauuccgaauaucggguucagacccuggguccggggacugucuagccgcauuuccaucuacuggaccauuguuaagccuggcgacauccuccugaucaacagcacagggaaccuuauugcucccagaggauauuuuaagauccggaauggcaaaucuuccauuaugcgcagcgaugccccuaucggcaacuguucuagcgagugcauuacccccaauggguccaucccgaacgacaagccuuuccagaaugugaacagaaucaccuacggagcuuguccccgguaugugaaacaaaauacacugaagcucgccacgggcaugcgcaacgucccugaaaaacagaccagagggauuuuuggagcgaucgccggcuucauugagaaugggugggaaggaaugguggauggcugguacggcuuucggcaccagaacucugaggggacaggacaggcugccgaccuuaagagcacccaagcugccaucgaucagauuaauggcaaacugaacagacugaucgagaagacaaaugaaaaguuccaccagaucgagaaagaguucuccgaaguugaagggcgcauucaagaccucgagaaguauguggaggauaccaaaaucgaccuguggagcuacaacgccggacugcucgucgcucuggaaaaucagcauacgauugaucuuacagacucugagaugaacaagcuguuugaacggaccagaaaacagcuccgcgagaacgcggaagauaugggcaaugggugcuucaagaucuaccacaagugugacaacgccugcauuggcuccauccggaauggaaccuaugaccaugauguguacagagacgaggcucugaacaaucgcuuucagauuaaaggcguugagcuuaagagcggguauaaagauuggauccuguggaucucuuucgccauuuccugcuuucuccugugugugguccugcucggauucaucaugugggccugccaaaagggcaacauucgguguaauaucugcauuuga

SEQ ID NO: 184051 - RNA, 1701 nt, Artificial Sequence
  derived and/or modified sequence opt5 from hemagglutinin__InfluenzaA__ABG47950
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccucccuggggacgcucgaguuuauuaacgaagacuucaauuggaccggaguggcucaggauggcaagagcuauucuugcaagcggggcuccgucaacagcuuuuucucucgccugaauuggcuucacaaacuggaguacaaguauccugcccucaacgugacaaugcccaauaacgggaaauuugacaagcuguacaucuggggaguucaucacccuuccaccgauagcgaccaaacaucucuguacgcgagagccuccggccgggugaccgucagcacgaaacgcucccagcagacagugauuccgaauaucggguucagacccugggugcggggacucucuagccgcauuuccaucuauuggaccauugucaagccuggcgacauccugcuuaucaacagcacagggaaccugauugcucccagaggauacuuuaagauccggaccggcaaaucuuccauuaugcgcagcgaugccccuaucggcaauuguucuagcgagugcauuacccccaacgggaauaucccgaacgacaagccuuuccagaauguuaacagaaucacauauggagcuuguccccgguacgugaaacaaaauacgcucaagcuggccaccggcaugcgcaacgugccugaaaaacagacaagagggauuuuuggagcgaucgccggcuucauugagaaugggugggaaggaauggucgauggcugguauggcuuucggcaccagaacuccgaggggaccggacaggcugccgaccuuaagucuacacaagcugccaucgaucagauuaauggcaaacugaacagacucaucgagaagaccaaugaaaaguuccaucagaucgagaaagaguucagcgaaguggaagggcgcauucaagaccuggagaaguacguugaggauacgaaaaucgaccugugguccuauaacgccggauuucucguggcucuggaaaaucagcacacaauugaucuuaccgacagcgagaugaacaagcuguucgaacggaccagaaaacagcuccgcgagaacgcggaagauaugggcaaugggugcuuuaagaucuaccauaagugugacaacgccugcauuggcucuauccggaauggaacauacgaccacgaugucuauagagacgaggcucugaacaaucgcuuccagauuaaaggcguggagcuuaaguccggguacaaagauuggauccuguggaucagcuuugccauuucuugcuuccuccuguguguugugcugcucggauuuaucaugugggccugccaaaagggcaacauucgguguaauaucugcauuuga

SEQ ID NO: 184052 - RNA, 1701 nt, Artificial Sequence
  derived and/or modified sequence opt5 from hemagglutinin__InfluenzaA__ABG47961
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuauuccugcaagcggggcagcgucaacagcuuuuucucccgccucaauuggcugcacaaacuugaguacaaguauccugcccugaacgugacaaugcccaauaacgggaaauuugacaagcucuacaucuggggaguucaucacccuagcaccgauucugaccaaacaucccuguacgugagagcgagcggcggggucaccguguccacgaaacggucucagcagacagugauuccgaauaucggaagccgccccugggucagaggccuguccagccggauuucuaucuauuggaccauuguuaagccuggggacauccuccugaucaacuccacaggaaaccuuauugcuccccgcggcuacuucaagaugagaaauggcaaaagcucuaucaugcggagcgaugccccuauugggaacuguuccucugagugcaucacccccaauggaagcauuccgaacgacaagccuuuucagaaugugaaccgcaucaccuauggcgccugucccagauacgugaaacaaaauacacugaagcucgcuacggggaugcggaacgucccugaaaaacagacccgcggaaucuucggcgccauugcgggguuuaucgagaauggaugggaaggcaugguggauggcugguauggguucagacaccagaacuccgagggaacaggccaggccgcugaccugaagucuacccaagccgcuauugaucagaucaaugggaaacuuaaccggcugauuggaaagacaaaugagaaguuucaucagaucgaaaaagaguucucugaaguugagggcagaauccaagaccucgaaaaguacguggaggauaccaaaauugaccugugguccuauaacgccgagcugcucgucgcccuggaaaaucagcacacgaucgaucuuacagacagcgagaugaacaagcuguucgaacgcacccggaaacagcucagagagaacgcugaagauauggggaauggcugcuuuaagauuuaccauaagugugacaacgcgugcaucggaucuauucgcaauggcaccuacgaccacgauguguaucgggacgaggcccugaacaauagauuccagaucaaagggguugagcuuaaguccggauacaaagauuggauucuguggaucagcuuugcuaucuccugcuuccuccugugugugguccugcucggcuuuauuaugugggccugccaaaaggggaacauccgcuguaauauuugcaucuga

SEQ ID NO: 184053 - RNA, 1701 nt, Artificial Sequence; identical to SEQ ID NO: 184048
  derived and/or modified sequence opt5 from hemagglutinin__InfluenzaA__ABG47972

SEQ ID NO: 184054 - RNA, 1701 nt, Artificial Sequence; identical to SEQ ID NO: 184048
  derived and/or modified sequence opt5 from hemagglutinin__InfluenzaA__ABG47983

SEQ ID NO: 184055 - RNA, 1701 nt, Artificial Sequence; identical to SEQ ID NO: 184048
  derived and/or modified sequence opt5 from hemagglutinin__InfluenzaA__ABG47994

SEQ ID NO: 184056 - RNA, 1701 nt, Artificial Sequence
  derived and/or modified sequence opt5 from hemagglutinin__InfluenzaA__ABG48005
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucaaucagauuaacggcaaacugaauagacugaucgagaagacaaacgaaaaguuccaucagaucgagaaagaguucuccgaaguugaagggcgcauucaagaucucgagaaguacguggaggacaccaaaaucgaucuguggagcuauaaugccggacugcucgucgcucuggaaaaccagcacacgauugaccuuacagauucugagaugaacaagcuguuugaacggaccagaaaacagcuccgcgagaaugcggaagacaugggcaacgggugcuucaagaucuaccauaagugugauaaugccugcauuggcuccauccggaacggaaccuacgaccacgacguguauagagaugaggcucugaauaaccgcuuucagauuaaaggcguugagcuuaagagcggguacaaagacuggauccuguggaucucuuucgccauuuccugcuuucuccugugugugguccugcucggauucaucaugugggccugccaaaagggcaauauucgguguaacaucugcauuuga

SEQ ID NO: 184057 - RNA, 1701 nt, Artificial Sequence; identical to SEQ ID NO: 184048
  derived and/or modified sequence opt5 from hemagglutinin__InfluenzaA__ABG48016

SEQ ID NO: 184058 - RNA, 1701 nt, Artificial Sequence; identical to SEQ ID NO: 184048
  derived and/or modified sequence opt5 from hemagglutinin__InfluenzaA__ABG48027

SEQ ID NO: 184059 - RNA, 1698 nt, Artificial Sequence
  derived and/or modified sequence opt5 from hemagglutinin__InfluenzaA__ABG48049
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccacccauuacucucggcgcuucacgcccgagauugccaaaagaccuaaggugcgggaccaggaagggcgcaucaauuauuacuggacacuucuggagcccggagauaccauuaucuuugaggcgaacggcaaucucauugccccuagauaugcuuucgcccugagccggggguuuggauccggcaucauuacaagcaacgcucccauggacgaaugugaugccaagugccagaccccgcaaggcgcgaucaauucuucccuuccuuuccagaacgugcaccccgucaccaucggggaguguccuaaauacgugcgcagcgccaagcugagaaugguuacaggacuccggaauauucccucuauccagagccgcggccuguuuggggcuauugccggauucaucgaaggcggguggacgggaaugguggacggcugguauggcuaccaucaccagaacgagcaaggguccggauacgcugccgaucagaaaucuacccagaaugccauuaacggcaucacaaauaaggucaacagcgugaucgaaaagaugaauacccaguuuacagcuguugggaaagaguucaacaaacuggagagacggauggaaaaucucaacaagaagguggacgauggauuccuggacauuuggaccuauaacgcggagcuucugguccuccuggaaaaugagcgcacgcuugacuuucacgauuccaacgugaaaaaucuguacgaaaaggucaaaagccaacucaagaacaaugccaaagagaucggcaacgggugcuucgaguuuuaucauaaguguaauaacgaaugcauggagucugugaagaauggcacauacgacuaucccaaauacuccgaagagagcaagcugaacagagagaaaauugauggaguuaagcuggaaucuaugggcguguaucagauccucgcuauuuacuccaccgucgccagcucccuggugcuucugguuucucucggggccaucagcuucuggaugugcuccaauggaucucugcagugucggaucugcauuuga

SEQ ID NO: 184060 - RNA, 1701 nt, Artificial Sequence; identical to SEQ ID NO: 183674
  derived and/or modified sequence opt5 from hemagglutinin__InfluenzaA__ABG48060

SEQ ID NO: 184061 - RNA, 1701 nt, Artificial Sequence; identical to SEQ ID NO: 183674
  derived and/or modified sequence opt5 from hemagglutinin__InfluenzaA__ABG48071

SEQ ID NO: 184062 - RNA, 1701 nt, Artificial Sequence
  derived and/or modified sequence opt5 from hemagglutinin__InfluenzaA__ABG48082
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucugcauccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccuccugaucaacuccacaggcaaucuuauugcuccccgcggguauuucaagaucagaagcggaaagucuagcauuaugcgguccgacgccccuaucggcaaauguaacucugaaugcauuacccccaauggcagcaucccgaacgggaagccuuuucagaaugugaaccgcaucaccuacggagcuugucccagauaugugaaacagaauacacugaagcucgccacgggcaugcggaacgucccugagaaacaaacccgcgggauuuucggagcgaucgccggcuuuauugaaaaugggugggagggaaugauggauggcugguacggcuucagacaccagaacuccgaggggacaggacaggcugccgaccuuaagagcacccaagcugccaucaaucagauuaacggcaaacugaaucggcugaucgaaaagacaaacgagaaguuucaccagaucgaaaaagaguucucugaaguggaggggcgcauucaggaucucgagaaguauguugaagacaccaaaaucgaucugugguccuacaaugccgagcugcucguggcucuggaaaaccaacauacgauugaccuuacagauagcgagaugaacaagcuguucgaaagaaccaaaaagcagcuccgggagaaugcggaggacaugggaaacggcugcuuuaagaucuaucacaaaugugauaaugccugcauugggucuaucagaaacggcaccuacgaccaugaugucuaccgcgacgaagcucugaauaaccgguuccagauuaagggaguggagcuuaaauccggcuauaaggacuggauccuguggaucagcuuugccauuuccugcuuccuccuguguaucguucugcucggguuuauuaugugggccugccagaaaggaaauaucagauguaacauuugcaucuga

SEQ ID NO: 184063 - RNA, 1701 nt, Artificial Sequence
  derived and/or modified sequence opt5 from hemagglutinin__InfluenzaA__ABG48104
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagccgcgccuauuccaauuguuacccuuaugacgugcccgauuacguuucucugagaagccuuguggcuuccagcgggacgcuggaauuuaacaaugagucuuucaacuggaccggagucgcccaaaauggcacauccagcgcuugcaagcggcgcucugacaaauccuuuuucagcagacucaacuggcugcaccagcuuaaguauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugcgcggggucuccagccggauuucuaucuacuggaccauuguuaagccuggagacauccugcucaucaacuccacaggcaaucugauugcucccagaggguauuucaaaauccggagcggaaagucuagcauuaugcgcuccgacgccccuaucggcaaguguaacucugaaugcauuacccccaauggcagcaucccgaacgauaaaccuuuucagaaugugaacagaaucaccuacgggcccuguccucgguaugugaagcagaauacacuuaaacuggcuacgggaaugcgcaacguccccgagaagcaaaccagaggcauuuucggggccaucgcgggauuuauugaaaauggcugggaggggaugauggacggaugguacggcuuccggcaccagaacuccgagggcacagggcaggccgcugaucucaaaagcacccaagccgcuaucaaucagauuaacggaaagcugaauagacuuaucgagaaaacaaacgaaaaguuucaucagaucgaaaaggaguucucugaaguggagggccgcauucaggaccuggagaaauauguugaagauaccaagaucgaccucugguccuacaaugccgagcugcugguggcccucgaaaaccaacacacgauugaucugacagacagcgagaugaacaaacuuuucgaacggaccaagaaacagcugagagagaaugcugaggauauggggaacggaugcuuuaagaucuaucauaagugugacaaugcgugcauuggcucuauccgcaacgggaccuacgaucacgacgucuaccgggacgaagcccucaauaacagauuccagauuaaaggcguggagcugaaguccggauauaaagauuggauccuuuggaucagcuuugcuauuuccugcuuccugcucuguaucguucugcugggcuuuauuaugugggccugccagaaggggaauauccgcuguaacauuugcaucuga

SEQ ID NO: 184064 - RNA, 1701 nt, Artificial Sequence; identical to SEQ ID NO: 183664
  derived and/or modified sequence opt5 from hemagglutinin__InfluenzaA__ABG48115

SEQ ID NO: 184065 - RNA, 1701 nt, Artificial Sequence; identical to SEQ ID NO: 183671
  derived and/or modified sequence opt5 from hemagglutinin__InfluenzaA__ABG48126

SEQ ID NO: 184066 - RNA, 1701 nt, Artificial Sequence; identical to SEQ ID NO: 183586
  derived and/or modified sequence opt5 from hemagglutinin__InfluenzaA__ABG48148

SEQ ID NO: 184067 - RNA, 1701 nt, Artificial Sequence; identical to SEQ ID NO: 183586
  derived and/or modified sequence opt5 from hemagglutinin__InfluenzaA__ABG48159

SEQ ID NO: 184068 - RNA, 1701 nt, Artificial Sequence
  derived and/or modified sequence opt5 from hemagglutinin__InfluenzaA__ABG48170
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugaaauccgacgccccuaucggcaaguguaacuuugaaugcauuacccccaauggcucuaucccgaacgggaaaccuuuccagaaugugaaccggaucaccuacggagcuuguccccgcuaugugaagcagaauacacuuaaacuggccacgggcaugagaaacgucccugagaagcaaacccgggggauuuuuggagcgaucgccggcuucauugaaaaugggugggagggaaugauggauggcugguacggcuuucgccaccagaacagcgaggggacaggacaggcugccgaccucaaauccacccaagcugccaucaaucagauuaacggcaagcugaauagacuuaucgaaaagacaaacgagaaauuccaucagaucgaaaaggaguucagcgaaguggaggggcggauucaggaucuggagaaauauguugaagacaccaagaucgaucucuggucuuacaaugccgagcugcugguggcucucgaaaaccaacacacgauugaccugacagauuccgagaugaacaaacuuuuugaaagaaccaagaagcagcugcgcgagaaugcggaggacaugggaaacggcugcuucaaaaucuaucauaagugugauaaugccugcauugggagcauccggaacggcaccuacgaccacgaugucuacagagacgaagcucucaauaaccgcuuucagauuaaaggaguggagcugaagucuggcuauaaagacuggauccuuuggaucuccuucgccauuagcugcuuucugcucuguaucguucugcugggguucauuaugugggccugccagaagggaaauauccgguguaacauuugcaucuga

SEQ ID NO: 184069 - RNA, 1701 nt, Artificial Sequence
  derived and/or modified sequence opt5 from hemagglutinin__InfluenzaA__ABG48181
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccuaugcuugcaaaagacggagcgacaaguccuuuuucucucgccucaacuggcugcaccagcuuaaguacaaauauccugcccugaaugugaccaugcccaacaaugagaaguuugauaaacucuacauuuggggcguucaucacccugggacagacagcgaucagaucucucuguacgcgcaggccuccggaagagugaccgucagcacgaagcggucccaacagacagugauuccgaacaucggcucucgccccugggugagaggggucagcucccggauuagcaucuauuggaccauuguuaaaccuggagacauccugcucaucaacucuacaggcaaucugauugcuccccgcggguacuucaagaucagauccggaaagagcucuauuaugcggagcgacgccccuaucggcaaauguaacuccgaaugcauuacccccaauggcucuaucccgaacgauaagccuuuucagaaugugaaccgcaucaccuauggggcuugucccagauacgugaaacagaauacacuuaagcuggccacgggaaugcggaacgucccugagaaacaaacccgcggcauuuucggggcgaucgccggauuuauugaaaauggcugggaggggaugauggacggaugguauggcuucagacaccagaacagcgagggcacagggcaggcugccgaucucaaguccacccaagcugccaucaaucagauuaacggaaaacugaaucggcuuaucgaaaagacaaacgagaaguuucaucagaucgaaaaagaguucagcgaaguggagggccgcauucaggaccuggagaaguacguugaagauaccaaaaucgaccucuggucuuauaaugccgagcugcugguggcucucgaaaaccaacacacgauugaucugacagacuccgagaugaacaaacuuuucgaaagaaccaagaagcagcugcgggagaaugcggaggauauggggaacggaugcuuuaagaucuaccauaaaugugacaaugccugcauuggcagcaucagaaacgggaccuacgaucacgacgucuaucgcgacgaagcucucaauaaccgguuccagauuaagggcguggagcugaaaucuggauacaaggauuggguucuuuggaucuccuuugccaucagcugcuuccugcucuguauugugcugcugggcuuuaucaugugggccugccagaaagggaauauuagauguaacaucugcauuuga

SEQ ID NO: 184070 - RNA, 1701 nt, Artificial Sequence; identical to SEQ ID NO: 183586
  derived and/or modified sequence opt5 from hemagglutinin__InfluenzaA__ABG48192

SEQ ID NO: 184071 - RNA, 1701 nt, Artificial Sequence
  derived and/or modified sequence opt5 from hemagglutinin__InfluenzaA__ABG48203
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcugccaucaaucagaucaacggaaagcucaaucggcugauuggcaagacgaacgagaaauuucaucagaucgaaaaggaguucucugaagucgaggggcgcauucaggaucuugaaaaauacguggaggacacaaagaucgaucugugguccuauaaugccgagcuccugguugcucuggaaaaccaacacaccauugaccucaccgauagcgagaugaacaaacuguucgaaagaacaaagaagcagcuucgggagaaugcggaagacaugggaaacggcugcuuuaaaaucuaccauaagugugauaaugccugcauugggucuaucagaaacggcaccuaugaccacgacguguaccgcgaugaggcucugaauaaccgguuccagaucaaaggagucgagcucaaguccggcuacaaagacuggauucuguggaucagcuuugccauuuccugcuuccuucuguguguggcccuccugggguuuaucaugugggcuugccagaagggaaauauuagauguaacguuugcaucuga

SEQ ID NO: 184072 - RNA, 1701 nt, Artificial Sequence; identical to SEQ ID NO: 183540
  derived and/or modified sequence opt5 from hemagglutinin__InfluenzaA__ABG48214

SEQ ID NO: 184073 - RNA, 1701 nt, Artificial Sequence; identical to SEQ ID NO: 183540
  derived and/or modified sequence opt5 from hemagglutinin__InfluenzaA__ABG48236

SEQ ID NO: 184074 - RNA, 1701 nt, Artificial Sequence
  derived and/or modified sequence opt5 from hemagglutinin__InfluenzaA__ABG48247
augaagaccaucauugcccugagcuacauccucugccugguguucgcucagaaacuucccggcaacgacaauaacacagccacgcugugucucgggcaccaugcggucccuaauggaaccauuguuaagacaaucaccaacgaucaaauugaggugacaaaugcuaccgaacuggugcaguccucuagcacaggcgggaucugcgacuccccgcaccagauccuugauggagagaacuguacccugauugacgcccuccugggcgauccccagugcgacggguuucaaaauaaaaagugggaucuguucgucgaaagaucuaaagccuauagcaacuguuacccuuaugacgugcccgaucaugcuucccuccggucucugguugccagcuccggaacgcuugaguuuaauaacgaaucuuucgacuggaccggcgugacacagaauggcaccucuuccgcuugcaagcgcagaagcaacaagagcuuuuucucccggcugaauuggcucacacaccugaaauacaaguauccugcccuuaacgucaccaugcccaauaacgagaaauuugauaagcuguacaucuggggagugcaucacccugggacggacagcgaucagauuucucucuaugcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguacuucaagaucagauccggaaaaagcucuauuaugcggagcgaugccccuaucggcaaguguaauuccgagugcaucacacccaacggcucuauuccgaaugacaaaccuuuucagaacgucaaucgcaucacguauggggcuugucccagauacguuaagcagaacacccugaaacuugccacaggaaugcggaaugugccugaaaagcaaacccgcggcauuuucggggcgaucgccggauuuauugagaacggcugggaagggaugguggauggaugguauggcuucagacaccagaauagcgagggcacagggcaggcugccgaccugaaauccacccaagcugccaucaaccagaucaauggaaagcucaaccggcugauuggcaagacgaaugagaaauuucaucagaucgaaaaggaguucagcgaagucgaggggcgcauucaggaucuugaaaaauacguggaggacacaaagaucgaucuguggucuuauaacgccgagcuccugguugcucuggaaaaccaacacaccauugaccucaccgauuccgagaugaauaaacuguucgaaagaacaaagaagcagcuucgggagaacgcggaagacaugggaaauggcugcuuuaaaaucuaccauaagugugauaacgccugcauugggagcaucagaaauggcaccuaugaccacgacguguaccgcgaugaggcucugaacaaucgguuccagaucaaaggagucgagcucaagucuggcuacaaagacuggauucuguggaucuccuuugccauuagcugcuuccuucuguguguggcccuccugggguuuaucaugugggcuugccagaagggaaacauuagauguaauaucugcaucuga

SEQ ID NO: 184075 - RNA, 1701 nt, Artificial Sequence
  derived and/or modified sequence opt5 from hemagglutinin__InfluenzaA__ABG48269
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcccgacaggcgggaucugcgacucuccccaccagauccuugauggagagaauuguacccugauugacgcccuccugggcgauccucagugcgacggguuucaaaacaaaaagugggaucuguucgucgaaagaucuaaagcccauagcaauuguuaucccuacgacgugccugauuaugcuucccuccggucucugguugccagcuccggaacgcuugaguuuaacaaugagagcuucaacuggaccggcgugacacagaauggcaccucuuccgcuugcaagcgcagaagcaacaaguccuuuuucucccggcugaauuggcucacacaccugaaauuuaaguaccccgcccuuaacgucaccaugccuaauaacgaaaaauucgacaagcuguauaucuggggagugcaucacccggggacggauaacgaccagauuagccucuacgcgcaggccucuggccgcaucacaguuuccaccaaaagaagccaacagacagugauucccaauaucgggucccggccucgcgucagagaugugcccucucggauuagcaucuauuggaccaucgugaagccuggagacauucugcugaucaacuccaccggcaaucucauugcuccccgcggguacuuuaagaucagaagcggaaaaucuuccauuaugcggagcgacgccccgaucggcaaguguaacucugagugcaucacaccuaauggcagcauucccaacgauaaaccuuuccagaaugucaaccgcaucacguacggggcuugucccagauauguuaagcagaauacccugaaacuugccacaggaaugcggaacgugcccgaaaagcaaacccgcggcauuuuuggggcgaucgccggauucauugagaauggcugggaagggaugguggacggaugguacggcuuuagacaccagaacuccgagggcacagggcaggcugccgaucugaaaucuacccaagcugccaucaaucagaucaacggaaagcucaaucggcugauuggcaagacgaacgagaaauuccaucagaucgaaaaggaguucagcgaagucgaggggcgcauucaggaccuugaaaaauauguggaggauacaaagaucgaccugugguccuacaacgccgagcuccugguugcucuggaaaaucaacacaccauugaucucaccgacagcgagaugaacaaacuguuugaaagaacaaagaagcagcuucgggagaaugcggaagauaugggaaacggcugcuucaaaaucuaucauaagugugacaaugccugcauugggucuaucagaaacggcaccuacgaucacgacguguaucgcgacgaggcucugaauaaccgguuucagaucaaaggagucgagcucaaguccggcuacaaagauuggauucuguggaucagcuucgccauuucuugcuuucuucuguguguggcccuccugggguucaucaugugggcuugccagaagggaaauauuagauguaacaucugcaucuga

SEQ ID NO: 184076 - RNA, 1701 nt, Artificial Sequence
  derived and/or modified sequence opt5 from hemagglutinin__InfluenzaA__ABG48291
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaguccgaguacaaauauccugcgcuuaacgugagcaugcccaauaacggaaaguuuaauaaacuguacaucuggggcguucaucacccuucuacagacuccgaucaaaccagccucuacgugagagccuccgggcgggucacagugucuaccaagcgcagccagcagacggugacaccgaacauuggauccagacccuggguccggggccugagcucucgcaucuccauuuauuggaccaucguuaaaccuggggacauucugcucaucaacagcacaggaaaucugaucgcucccagaggcuacuucaagauucggaacggcaagucuagcaucaugcgcuccgacgccccuauugggaccuguucuuuugagugcaucacccccaauggaagcauuccgaacgauaaaccuuuccagaaugugaacagaaucacauauggcgcuuguccccgguacgugaagcaaaauacgcuuaaacuggccaccgggaugcgcaacgucccugaaaagcagacaagaggaaucuuuggcgcgauugccggguucaucgagaauggaugggaaggcaugguggacggcugguauggguuucggcaccagaacuccgagggaaccggccaggcugccgaucucaaaagcacacaagcugccauugaccagaucaaugggaagcugaacagacuuauugagaaaaccaaugaaaaguuccaucagaucgagaaggaguucucugaaguugaaggacgcauccaagaucuggagaaauacguggaggacacgaagauugaucucugguccuauaacgccgaacugcuggucgcucucgagaaucagcacacaaucgaccugaccgauagcgaaaugaacaaacuuuuugagaagacccggaaacagcugagagaaaacgcggaggacaugggcaaugggugcuucaagauuuaccauaagugugauaacgccugcaucggcucuauucgcaauggaacauacgaccacgacguguaucgggaugaggcucucaacaauagauuucagaucaaaggcguugaacugaaguccggguacaaagacuggauucuuuggaucagcuucgccaucuccugcuuucugcucugugugguccugcugggauucauuaugugggccugccaaaagggcaacauccgcuguaauauuugcaucuga

SEQ ID NO: 184077 - RNA, 1701 nt, Artificial Sequence
  derived and/or modified sequence opt5 from hemagglutinin__InfluenzaA__ABG48335
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagcugccaucgaucagauuaauggcaaacuuaacagacugaucgagaagacaaaugaaaaguuucaucagaucgagaaagaguucagcgaaguugaagggcgcauucaagaccucgagaaguacguggaggauaccaaaaucgaccuguggucuuauaacgccgaacugcucgucgcucuggagaaucagcacacgauugaucuuacagacuccgaaaugaacaagcuguucgagcggaccagaaaacagcuccgcgaaaacgcggaggauaugggaaauggcugcuuuaagaucuaccauaagugugacaacgccugcauugggagcauccggaauggcaccuacgaccacgauguguauagagacgaggcucugaacaaucgcuuccagauuaaaggaguugaacuuaagucuggcuacaaagauuggauccuguggaucuccuuugccauuagcugcuuccuccugugugugguccugcucggguuuaucaugugggccugccaaaagggaaacauucgguguaauaucugcauuuga

SEQ ID NO: 184078 - RNA, 1701 nt, Artificial Sequence
  derived and/or modified sequence opt5 from hemagglutinin__InfluenzaA__ABG48346
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcaauaaagccuauagcaacuguuacccuuaugacgugcccgauuacgcuucccugagaucucuuguugccagcuccgggacgcuggaguuuauuaaugaagacuucaacuggaccggaguggcucaggauggcaagagcuaugccugcaagcggggcucugucaauuccuuuuucagccgccucaacuggcugcacaaacuugaguacaaguauccugcgcugaaugugacaaugcccaacaaugggaaauuugacaagcucuacaucuggggaguucaucacccuucuaccgauuccgaccaaacaagccuguacgugagagccucuggccgggucaccguguccacgaaacgcagccagcagacagugauuccgaacaucggguccagacccuggguccggggacugucuagccgcauuuccaucuauuggaccauuguuaagccuggcgacauccuccugaucaacagcacagggaaucuuauugcucccagaggauacuucaagauccggaacggcaaaucuuccauuaugcgcagcgaugccccuaucggcaauuguucuagcgagugcauuacccccaacggguccaucccgaaugacagaccuuuucagaacgugaaucggaucaccuauggagcuuguccccgcuacgugaagcaaaacacacugaaacucgccacgggcaugagaaaugucccugaaaagcagacccgggggauuuucggagcgaucgccggcuuuauugagaacgggugggaaggaaugguggauggcugguauggcuucagacaccaaaauucugaggggacaggacaggcugccgaccugaaaagcacccaggcugccaucgaucagauuaacggcaaacuuaaucgccugaucgagaagacaaacgaaaaguuucaucagaucgagaaggaguucuccgaaguugaagggcggauucaagaccucgagaaauacguggaggauaccaagaucgaccuguggagcuauaaugccgaacugcucgucgcucuggagaaccagcacacgauugaucuuacagacucugaaaugaacaaacuguucgagagaacccgcaagcagcuccgggaaaaugcggaggauaugggaaacggcugcuuuaaaaucuaccauaagugugacaaugccugcauuggguccaucagaaacggcaccuacgaccacgauguguaucgcgacgaggcucugaauaaccgguuccagauuaagggaguugaacuuaaaagcggcuacaaggauuggauccuguggaucucuuuugccauuuccugcuuccuccugugugugguccugcucggguuuaucaugugggccugccaaaaaggaaauauuagauguaacaucugcauuuga

SEQ ID NO: 184079 - RNA, 1701 nt, Artificial Sequence; identical to SEQ ID NO: 184077
  derived and/or modified sequence opt5 from hemagglutinin__InfluenzaA__ABG48357

SEQ ID NO: 184080 - RNA, 1701 nt, Artificial Sequence
  derived and/or modified sequence opt5 from hemagglutinin__InfluenzaA__ABG48368
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagcugccaucgaucagauuaauggcaaacuuaacagacugaucgagaagacaaaugaaaaguuucaucagaucgagaaagaguucagcgaaguugaagggcgcauucaagaccucgagaaguacguggaggauaccaaaaucgaccuguggucuuauaacgccgaacugcucgucgcucuggagaaucagcacacgauugaucuuacagacuccgaaaugaacaagcuguucgagcggaccagaaaacagcuccgcgaaaacgcggaggauaugggaaauggcugcuuuaagguguaccauaagugugacaacgccugcaucgagagcauucggaaugggaccuacgaccacgauguuuauagagacgaagcucugaacaaucgcuuccagaucaaaggcguggagcuuaagucuggauacaaagauuggauucuguggaucuccuuugccaucagcugcuuccuccugugugucgugcugcucggcuuuauuaugugggccugccaaaaggggaacauccgguguaauauuugcaucuga

SEQ ID NO: 184081 - RNA, 1701 nt, Artificial Sequence; identical to SEQ ID NO: 183931
  derived and/or modified sequence opt5 from hemagglutinin__InfluenzaA__ABG67135

SEQ ID NO: 184082 - RNA, 1701 nt, Artificial Sequence; identical to SEQ ID NO: 183807
  derived and/or modified sequence opt5 from hemagglutinin__InfluenzaA__ABG67146

SEQ ID NO: 184083 - RNA, 1701 nt, Artificial Sequence
  derived and/or modified sequence opt5 from hemagglutinin__InfluenzaA__ABG67157
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcaauucuccccaccggaucaucgacgggaaaaacuguacccugauugaugcccuccugggagacccucauugcgauggcuuucagaauaaggagugggaccuguucgucgaacgcuccaaagccuauagcaacuguuaccccuaugaugugccugacuacgcuucccucagaucucugguugccagcuccgggacgcuugaguuuaucaaugaaaacuucaauuggaccggaguggcucaggauggcaagagcuaugccugcaagcggggcucugucaacuccuuuuucagccgccugaauuggcuccacaaacuggaguacaaguaucccgcgcuuaacgugacaaugccuaauaacgggaaauuugacaagcuguacauuuggggaguucaucacccgucuaccgauuccgaccaaacaagccucuacgugagagccucuggccgggucaccguguccacgaaacgcagccagcagacagugauccccgauauuggguauagaccuuggguccggggacuguccucucgcaucagcauuuacuggaccaucguuaagcccggcgacauccugcucauuaacuccacagggaaucugaucgcuccuagaggauauuucaaacuucggaacggcaagagcucuauuaugcgcuccgacgcccccaucggcaauuguagcucugagugcauuaccccgaacgggagcaucccuaaugauaagcccuuucagaacgugaauagaaucaccuacggagcuuguccucgguauauuaaacaaaacacacugaagcucgccacgggcaugcgcaaugugcccgaaaaacagaccagagggaucuucggagcgauugccggcuuuaucgagaacgggugggaaggaauggucgacggcugguacggcuuccggcaccaaaauuccgaggggacaggacaggcugccgaucugaagucuacccaggcugccauugaccagaucaacggcaaacuuaauagacugguggagaagacaaacgaaaaguuucaucagaucgagaaagaguucagcgaaguugaagggcgcauucaagaucucgagaaguauguggaggacaccaaaaucgaucugugguccuacaaugccgaacugcucgucgcucuggagaaccagcacacgauugaccuuacagauagcgaaaugaacaagcuguucgagcggaccaaaaagcagcucagagaaaaugcggaggacaugggaaacggcugcuuuaagaucuaccauaaaugugauaaugccugcauugggucuauccgcaacggcaccuaugaccacgacguguaccgggaugaggcucugaauaacagauuccagauuaagggaguugaacuuaaauccggcuauaaggacuggauccuguggaucagcuuugccauuucuugcuuccuccugugugugguccugcucggguuuaucaugugggccugccaaaaaggaaauauucgcuguaacaucugcauuuga

SEQ ID NO: 184084 - RNA, 1701 nt, Artificial Sequence; identical to SEQ ID NO: 184008
  derived and/or modified sequence opt5 from hemagglutinin__InfluenzaA__ABG67168

SEQ ID NO: 184085 - RNA, 1701 nt, Artificial Sequence; identical to SEQ ID NO: 184008
  derived and/or modified sequence opt5 from hemagglutinin__InfluenzaA__ABG67179

SEQ ID NO: 184086 - RNA, 1701 nt, Artificial Sequence
  derived and/or modified sequence opt5 from hemagglutinin__InfluenzaA__ABG67190
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuuuuccgacaggcagaauuugcgacagcccccaccggauccuggaugggaaaaauuguacccucaucgacgcccugcugggagauccucauugcgacggcuuccagaacaaggagugggaucucuuugucgaacgcuccaaagccuauucuaauuguuaccccuaugacgugccugauuacgcuagccugagaucccuuguugccucuagcgggacgcuggaguucaccaacgaaaauuuuaacuggacaggaguggcucaggacggcaaguccuaugccugcaagcggggcagcgucaauucuuucuuuucccgccucaacuggcugcacaaacuugaguacaaguaucccgcgcugaaugugaccaugccuaacaaugggaaauucgauaagcucuacauuuggggaguucaucacccgagcacagacucugaucaaaccucccuguacgugagagccagcggcaaagucacggugucuacaaagcggucccagcagaccgugauccccgacauuggguaucgcccuugggucagaggacugagcucccggaucucuauuuacuggacaaucguuaagcccggcgacauucuccugaucaacagcaccgggaaccuuaucgcuccucgcggauauuuuaaaauuagaaauggcaaguccagcaucaugcggucugaugcccccauuggcaacuguuccagcgagugcaucaccccgaaugggucuauuccuaacgacaaacccuuccagaaugugaaccgcaucacauacggagcuuguccuagauaugugaagcaaaauacgcugaaacucgccaccggcaugcggaacguccccgaaaagcagacacgcgggaucuuuggagcgauugccggcuucaucgagaaugggugggaaggaaugguggauggcugguacggcuuuagacaccagaacagcgaggggaccggacaggcugccgaccugaaauccacacaagcugccauugaucagaucaauggcaaacuuaaccggcugguugagaagaccaaugaaaaguuccaucagauugagaaggaguucucugaaguggaagggagaauccaagaccucgagaaauaugucgaggauacgaagaucgaccuguggagcuacaacgccgaacugcucguggcucuggagaaucagcacacaauugaucuuaccgacuccgaaaugaacaaacuguuugagcgcacccggaagcagcucagagaaaacgcggaggauaugggaaauggcugcuucaagaucuaccauaaaugugacaacgccugcauugggagcauccgcaauggcacauaugaccacgauguuuaccgggacgaggcucugaacaauagauuucagauuaagggaguggaacuuaaaucuggcuauaaggauuggauccuguggauuuccuucgccaucagcugcuuucuccugugugucgugcugcucggguucaucaugugggccugccaaaaaggaaacauucgcuguaauaucugcauuuga

SEQ ID NO: 184087 - RNA, 1701 nt, Artificial Sequence
  derived and/or modified sequence opt5 from hemagglutinin__InfluenzaA__ABG67212
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacagauauccugcgcugaacgugacaaugcccaauaacgggaaguuugacaaacucuacaucuggggaguucaucacccuuccaccgauagcgaccaaacaucucuguacgugcgggccuccggccgcgucaccgugagcacgaagagaucccagcagacagugauuccgaauaucggguuccggcccuggguccgcggacugucuagcagaauuuccaucuauuggaccauuguuaaaccuggcgacauccuccugaucaacagcacagggaaccuuauugcuccccggggauacuuuaagauccgcaauggcaagucuuccauuaugagaagcgaugccccuaucggcaacuguucuagcgagugcauuacccccaauggguccaucccgaacgacaaaccuuuccagaaugugaaccggaucaccuauggagcuuguccccgcuacgugaagcaaaauacacugaaacucgccacgggcaugagaaacgucccugaaaagcagacccgggggauuuuuggagcgaucgccggcuucauugagaaugggugggaaggaaugguggauggcugguauggcuuuagacaccagaacucugaggggacaggacaggcugccgaccugaaaagcacccaagcugccaucgaucagauuaauggcaaacuuaaccgccugaucgagaagacaaaugaaaaguuccaucagaucgagaaggaguucuccgaaguugaagggcggauucaagaccucgagaaauacguggaggauaccaagaucgaccuguggagcuauaacgccggacugcucgucgcucuggaaaaucagcacacgauugaucuuacagacucugagaugaacaaacuguuugaaagaacccgcaagcagcuccgggagaacgcggaagauaugggcaaugggugcuucaaaaucuaccauaagugugacaacgccugcauuggcuccaucagaaauggaaccuacgaccacgauguguaucgcgacgaggcucugaacaaucgguuucagauuaagggcguugagcuuaaaagcggguacaaggauuggauccuguggaucucuuucgccauuuccugcuuucuccugugugugguccugcucggauucaucaugugggccugccaaaaaggcaacauuagauguaauaucugcauuuga

SEQ ID NO: 184088 - RNA, 1701 nt, Artificial Sequence; identical to SEQ ID NO: 184048
  derived and/or modified sequence opt5 from hemagglutinin__InfluenzaA__ABG67223

SEQ ID NO: 184089 - RNA, 1701 nt, Artificial Sequence
  derived and/or modified sequence opt5 from hemagglutinin__InfluenzaA__ABG67234
augaagaccaucauugcccugagcuacauccucugccugguguucgcucagaaacuucccggcgacgauaacuccacagccacgcugugucucgggcaccaugcggucccuaauggaacccugguuaagacaauuaccaacgaccaaaucgaggugacaaaugcuaccgaacuugugcagucuagcuccacaggcagaauuugcgauucuccgcaccggauccuggacgggaaaaacuguacccucaucgaugcccugcugggagacccccauugcgauggcuuucagaauaaggagugggaccucuucgucgaacgcagcaaagccuauuccaacuguuacccuuaugaugugcccgacuacgcuucucugagaagccuuguugccuccagcgggacgcuggaguuuauuaaugaagauuucaacuggaccggaguggcucaggacggcaagucuuaugccugcaagcggggcuccgucaauagcuuuuucucucgccucaacuggcugcacaaacuugaguacaaguauccugcgcugaaugugacaaugcccaacaaugggaaauuugauaagcucuacaucuggggaguucaucacccuuccaccgacagcgaccaaacaucucuguacgugagagccuccggccgggucaccgugagcacgaaacgcucccagcagacagugauuccgaacaucggguucagacccuggguccggggacugucuagccgcauuuccaucuauuggaccauuguugagccuggcgauauccuccugaucaauagcacagggaaccuuauugcucccagaggauacuuuaagauccggaacggcaagucuuccauuaugcgcagcgacgccccuaucggcaauuguucuagcgaaugcauuacccccaacggguccaucccgaaugauaaaccuuuccagaacgugaauagaaucaccuauggagcuuguccccgguacgugaagcaaaacacacugaaacucgccacgggcaugcgcaaugucccugagaagcagaccagagggauuuuuggagcgaucgccggcuucauugaaaacgggugggagggaaugguggacggcugguauggcuuucggcaccaaaauucugaggggacaggacaggcugccgaucugaaaagcacccaggcugccaucgaccagauuaacggcaaacuuaauagacugaucgaaaagacaaacgagaaguuccaucagaucgaaaaggaguucuccgaaguugaggggcgcauucaagaucucgagaaauacguggaagacaccaagaucgaucuguggagcuauaaugccggacugcucgucgcucuggagaaccagcacacgauugaccuuacagauucugaaaugaauaaacuguuugagcggaccagaaagcagcuccgcgaaaacgcggaggacaugggcaacgggugcuucaaaaucuaccauaagugugacaaugccugcauuggcuccauccggaacggaaccuacgaucacgacguguauagagaugaggcucugaauaaccgcuuucagauuaagggcguugaacuuaaaagcggguacaaggacuggauccuguggaucucuuucgccauuuccugcuuucuccugugugugguccugcucggauucaucaugugggccugccaaaaaggcaauauucgguguaacaucugcauuuga

SEQ ID NO: 184090 - RNA, 1701 nt, Artificial Sequence
  derived and/or modified sequence opt5 from hemagglutinin__InfluenzaA__ABG67245
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucgaucagauugacggcaaacugaauagacugaucgagaagacaaacgaaaaguuccaucagaucgagaaagaguucuccgaaguugaagggcgcauucaagaucucgagaaguacguggaggacaccaaaaucgaucuguggagcuauaaugccggacugcucgucgcucuggaaaaccagcacacgauugaccuuacagauucugagaugaauaagcuguuugaacggaccagaaaacagcuccgcgagaacgcggaagacaugggcaacgggugcuucaagaucuaccauaagugugacaaugccugcauuggcuccauccggaacggaaccuacgaucacgacguguauagagaugaggcucugaauaaccgcuuucagauuaaaggcguugagcuuaagagcggguacaaagacuggauccuguggaucucuuucgccauuuccugcuuucuccugugugugguccugcucggauucaucaugugggccugccaaaagggcaauauucgguguaacaucugcauuuga

SEQ ID NO: 184091 - RNA, 1698 nt, Artificial Sequence; identical to SEQ ID NO: 183766
  derived and/or modified sequence opt5 from hemagglutinin__InfluenzaA__ABG67477

SEQ ID NO: 184092 - RNA, 1698 nt, Artificial Sequence; identical to SEQ ID NO: 183824
  derived and/or modified sequence opt5 from hemagglutinin__InfluenzaA__ABG67491

SEQ ID NO: 184093 - RNA, 1701 nt, Artificial Sequence
  derived and/or modified sequence opt5 from hemagglutinin__InfluenzaA__ABG67502
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugucugauuacguuagccugcgcucccuuguggcuagcucugggacgcuggaauuuaacaaugaguccuucaacuggaccggagucgcccaaaauggcacaagcucugcuugcaaaagacgguccgacaagagcuuuuucucucgccucaacuggcugcaccagcuuaaguauaaauaccccgcccugaaugugaccaugccuaacaaugagaaguuugauaaacucuauauuuggggcguucaucaccccgggacagacuccgaucagaucagccuguacgcgcaggccuccggaagagugaccgucucuacgaagcggagccaacagacagugauuccuaacaucggcucccgcccgugggugagagggauuagcucucggaucuccauuuacuggaccaucgucaaacccggagacauccugcucauuaacagcacaggcaaucugaucgcuccucgcggguauuucaagauuagaucuggaaagagcuccaucaugcggucugacgcccccauuggcaaauguaacagcgaaugcaucaccccuaauggcuccauccccaacgauaagccguuucagaauguuaaccgcauuaccuacgggccuugucccagauaugugaaacagaauacacuuaagcuggcuacgggaaugcggaacgugccugagaaacaaacccgcggcaucuucggggccauugcgggauuuaucgaaaauggcugggaggggaugauggacggaugguacggcuucagacaccagaacagcgagggcacagggcaggccgcugaucucaagucuacccaagccgcuauuaaucagaucaacggaaaacugaaucggcuuaucgaaaagacaaacgagaaguuucaucagauugaaaaagaguucuccgaagucgagggcagaauccaggaccuggagaaguauguggaagauaccaaaauugaccucuggagcuacaaugccgagcugcugguugcccucgaaaaccaacacacgaucgaucugacagacucugagaugaacaaacuuuucgaacgcaccaagaagcagcugcgggagaaugcugaggauauggggaacggaugcuuuaagauuuaucauaaaugugacaaugcgugcaucggcuccauuagaaacgggaccuacgaucacgacguguaccgcgacgaagcccucaauaaccgguuccagaucaagggcgucgagcugaaaagcggauauaaggauuggauccuuuggauuuccuuugcuaucucuugcuuccugcucuguauugugcugcugggcuuuaucaugugggccugccagaaagggaauauuagauguaacaucugcaucuga

SEQ ID NO: 184094 - RNA, 1701 nt, Artificial Sequence
  derived and/or modified sequence opt5 from hemagglutinin__InfluenzaA__ABG67524
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagccgcgccuauuccaauuguuacccuuaugacgugcccgauuacguuucucugagaagccuuguggcuuccagcgggacgcuggaauuuaacaaugagucuuucaacuggaccggagucgcccaaaauggcacauccagcgcuugcaagcggcgcucugacaaauccuuuuucagcagacucaacuggcugcaccagcuuaaguauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugcgcggggucuccagccggauuucuaucuacuggaccauuguuaagccuggagacauccugcucaucaacuccacaggcaaucugauugcucccagaggguauuucaaaauccggagcggaaagucuagcauuaugcgcuccgacgccccuaucggcaaguguaacucugaaugcauuacccccaauggcagcaucccgaacgauaaaccuuuucagaaugugaacagaaucaccuacgggcccuguccucgguaugugaagcagaauacacuuaaacuggcuacgggaaugcgcaacguccccgagaagcaaaccagaggcauuuucggggccaucgcgggauuuauugaaaauggcugggaggggaugauggacggaugguacggcuuccggcaccagaacuccgagggcacagggcaggccgcugaucucaaaagcacccaagccgcugugaaucagaucaacggaaagcugaauagacuuauugagaaaacaaacgaaaaguuucaucagaucgaaaaggaguucucugaaguugagggccgcauccaggaccuggagaaauauguggaagauaccaagauugaccucugguccuacaaugccgagcugcuggucgcccucgaaaaccaacacacgaucgaucugacagacagcgagaugaacaaacuuuucgaacggaccaagaaacagcugagagagaaugcugaggauauggggaacggaugcuuuaagauuuaucauaagugugacaaugcgugcaucggcucuauucgcaacgggaccuacgaucacgacguguaccgggacgaagcccucaauaacagauuccagaucaaaggcguugagcugaaguccggauauaaagauuggauucuuuggaucagcuuugcuaucuccugcuuccugcucuguauugugcugcugggcuuuaucaugugggccugccagaaggggaauauucgcuguaacaucugcauuuga

SEQ ID NO: 184095 - RNA, 1701 nt, Artificial Sequence; identical to SEQ ID NO: 183586
  derived and/or modified sequence opt5 from hemagglutinin__InfluenzaA__ABG67535

SEQ ID NO: 184096 - RNA, 1701 nt, Artificial Sequence; identical to SEQ ID NO: 183540
  derived and/or modified sequence opt5 from hemagglutinin__InfluenzaA__ABG67546

SEQ ID NO: 184097 - RNA, 1701 nt, Artificial Sequence
  derived and/or modified sequence opt5 from hemagglutinin__InfluenzaA__ABG67557
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacuccgagggcacagggcaggcugccgaccugaaaagcacccaagcuacgaucaaucagaucaacggaaagcucaaucggcugauuggcaagacaaacgagaaauuucaucagaucgaaaaggaguucucugaagucgaggggcgcauucaggaucuugaaaaauacguggaggacaccaagaucgaucugugguccuauaaugccgagcuccugguugcccuggaaaaccaacacaccauugaccucacagauagcgagaugaacaaacuguucgaaagaaccaagaagcagcuucgggagaaugcugaagacaugggaaacggcugcuuuaaaaucuaccauaagugugauaaugcgugcauugggucuaucagaaacggcacauaugaccacgacguguaccgcgaugaggcccugaauaaccgguuccagaucaaaggagucgagcucaaguccggcuacaaagacuggauucuguggaucagcuuugcuauuuccugcuuccuucuguguguggcccuccugggguuuaucaugugggccugccagaagggaaauauuagauguaacaucugcaucuga

SEQ ID NO: 184098 - RNA, 1701 nt, Artificial Sequence; identical to SEQ ID NO: 183540
  derived and/or modified sequence opt5 from hemagglutinin__InfluenzaA__ABG67568

SEQ ID NO: 184099 - RNA, 1701 nt, Artificial Sequence; identical to SEQ ID NO: 183540
  derived and/or modified sequence opt5 from hemagglutinin__InfluenzaA__ABG67579

SEQ ID NO: 184100 - RNA, 1701 nt, Artificial Sequence; identical to SEQ ID NO: 183540
  derived and/or modified sequence opt5 from hemagglutinin__InfluenzaA__ABG67590

SEQ ID NO: 184101 - RNA, 1701 nt, Artificial Sequence; identical to SEQ ID NO: 183540
  derived and/or modified sequence opt5 from hemagglutinin__InfluenzaA__ABG67601

SEQ ID NO: 184102 - RNA, 1701 nt, Artificial Sequence; identical to SEQ ID NO: 183540
  derived and/or modified sequence opt5 from hemagglutinin__InfluenzaA__ABG67612

SEQ ID NO: 184103 - RNA, 1701 nt, Artificial Sequence; identical to SEQ ID NO: 183540
  derived and/or modified sequence opt5 from hemagglutinin__InfluenzaA__ABG67623

SEQ ID NO: 184104 - RNA, 1701 nt, Artificial Sequence
  derived and/or modified sequence opt5 from hemagglutinin__InfluenzaA__ABG67634
augaagaccaucauugcccugagcuacauccucugccugguguucgcucagaaacuucccggcaacgacaauaacacagccacgcugugucucgggcaccaugcggucccuaauggaaccauuguuaagacaaucaccaacgaucaaauugaggugacaaaugcuaccgaacuggugcaguccucuagcacaggcgggaucugcgacuccccgcaccagauccuugauggagagaacuguacccugauugacgcccuccugggcgauccccagugcgacggguuucaaaauaaaaagugggaucuguucgucgaaagaucuaaagccuauagcaacuguuacccuuaugacgugcccgaucaugcuucccuccggucucugguugccagcuccggaacgcuugaguuuaauaacgaaucuuucgacuggaccggcgugacacagaauggcaccucuuccgcuugcaagcgcagaagcaacaagagcuuuuucucccggcugaauuggcucacacaccugaaauacaaguauccugcccuuaacgucaccaugcccaauaacgagaaauuugauaagcuguacaucuggggagugcaucacccugggacggacagcgaucagauuucucucuaugcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguacuucaagaucagauccggaaaaagcucuauuaugcggagcgaugccccuaucggcaaguguaauuccgagugcaucacacccaacggcucuauuccgaaugacaaaccuuuucagaacgucaaucgcaucacguauggggcuugucccagauacguuaagcagaacacccugaaacuugccacaggaaugcggaaugugccugaaaagcaaacccgcggcauuuucggggcgaucgccggauuuauugagaacggcugggaagggaugguggauggaugguauggcuucagacaccagaauagcgagggcacagggcaggcugccgaccugaaauccacccaagcugccaucaaccagaucaauggaaagcucaaccggcugauuggcaagacgaaugagaaauuucaucagaucgaaaaggaguucagcgaagucgaggggcgcauucaggaucuugaaaaauacguggaggacacaaagaucgaucuguggucuuauaacgccgagcuccugguugcucuggaaaaccaacacaccauugaccucaccgauuccaaaaugaauaagcuguucgagagaacaaagaaacagcuucgggaaaacgcggaggacaugggaaauggcugcuuuaagaucuaccauaaaugugauaacgccugcauugggagcaucagaaauggcaccuaugaccacgacguguaccgcgaugaagcucugaacaaucgguuccagaucaagggagucgagcucaaaucuggcuacaaggacuggauucuguggaucuccuuugccauuagcugcuuccuucuguguguggcccuccugggguuuaucaugugggcuugccagaagggaaacauuagauguaauaucugcaucuga

SEQ ID NO: 184105 - RNA, 1701 nt, Artificial Sequence; identical to SEQ ID NO: 183540
  derived and/or modified sequence opt5 from hemagglutinin__InfluenzaA__ABG67645

SEQ ID NO: 184106 - RNA, 1701 nt, Artificial Sequence
  derived and/or modified sequence opt5 from hemagglutinin__InfluenzaA__ABG67656
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacugggcuggcgugacccagaacggcacauccagcgccugcaagcgcagaucuaauaaguccuuuuucagccggcugaacuggcucacccaccugaaauacaaguauccugcgcuuaaugucacaaugcccaacaaugagaaauuugauaagcuguacaucuggggagugcaucacccugggaccgacucugaucagauuucccucuaugcccaggcuagcggccgcaucacgguuuccacaaaaagaucucaacagaccgugauuccgaacaucgggagccggccccgcgucagagacguguccagccggauuucuaucuacuggacaaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacccccaauggcagcauuccgaacgacaaaccuuuucagaaugucaaccgcaucacauauggggccugucccagauacguuaagcagaauacgcugaaacuugcgaccggaaugcggaacgugccugaaaagcaaacacgcggcauuuucggggccaucgcuggauuuauugagaauggcugggaagggaugguggauggaugguauggcuucagacaccagaacuccgagggcaccgggcaggccgcugaccugaaaagcacacaagccgccaucaaucagaucaacggaaagcucaaucggcugauuggcaagaccaacgagaaauuucaucagaucgaaaaggaguucucugaaauugaggggagaauccaggaucuugaaaaauacgucgaggacacgaagauugaucugugguccuauaaugcugagcuccugguggcgcuggaaaaccaacacacaaucgaccucaccgauagcgagaugaacaaacuguucgaacgcaccaagaagcagcuucgggagaaugccgaagacaugggaaacggcugcuuuaaaauuuaccauaagugugauaaugcuugcaucgggucuaucagaaacggcacauaugaccacgacguuuaccgcgaugaggcccugaauaaccgguuccagauuaaaggaguggagcucaaguccggcuacaaagacuggauccuguggauuagcuuugccaucuccugcuuccuucugugugucgcucuccugggguuuauuaugugggccugccagaagggaaauaucagauguaacaucugcauuuga

SEQ ID NO: 184107 - RNA, 1701 nt, Artificial Sequence
  derived and/or modified sequence opt5 from hemagglutinin__InfluenzaA__ABG67667
augaagaccaucauugcccugagcuacauccucugccagguguucgcucaaaaacugcccggcaacgacaauuccacagccacgcuuugucuggggcaccaugcggucccuaacggaacccucguuaagacaauuaccaaugaucagaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuucagaacaaggagugggaucuguucgucgaacgcagcaaagccuauuccaauuguuacccuuaugacgugcccgauuacgcuucucucagaagccugguugccuccagcgggacgcuugaguuuaccaacgaaggauucaauuggauuggcguggcucaagacggcaagucuuaugccugcaagcggggguccgucaacagcuuuuucucucgccugaauuggcuccacaaacuggaguacaaguauccugcgcuuaacgugacaaugcccaauaacgauaaauuugacaagcuguacaucuggggaguucaucacccuuccaccgauagcgaccagacaucucucuacgugcaggccuccggcagagucaccgugagcacgaaacggucccagcaaacagugauuccgaauaucgggucucgccccugggucagaggaauuagcucccggaucagcauuuauuggaccaucguuaagccuggcgacauccugcugauuaacucuacagggaaccucaucgcuccccgcggauacuucaagauuagaaauggcaaauccagcaucaugcggucugaugccccuauugacaacuguaauagcgagugcaucacccccaacggcuccaucccgaaugauaagccuuuucagaacgugaaucgcauuaccuauggggcuugucccagauacgugaaacagaacacacugaagcuggccacgggaaugcggaaugucccugaaaaacagacccgcggcaucuucggggcgauugccggauuuaucgagaacggcugggaagggaugauugacggaugguauggcuucagacaccaaaauucugagggcacagggcaggcugccgaucuuaagagcacccaggcugccaucgaccaaaucaacggaaaacucaaucggcugauugagaagacaaacgaaaaguuucaucagaucgagaaagaguucuccgaaguggaaggccgcauucaggaucuugagaaguacguugaggacaccaaaaucgaucuguggagcuauaaugccgaacuccugguggcucuggagaaccagcacacgauugaccucacagauucugaaaugaacaagcuguucgagagaacccggaaacaacuuagagaaaaugcggaggacauggggaacggaugcuuuaagaucuaccauaagugugacaaugccugcauuggcuccauccgcaacgggaccuacgaucacgacgucuaucgggaugaggcucugaauaacagauuccagaucaaaggcguggaacucaagagcggauacaaagacuggauucuguggaucucuuuugccauuuccugcuuccuucuguguguugugcuccugggcuuuaucaugugggccugccagaaggggaauauucgcuguaacaucugcaucuga

SEQ ID NO: 184108 - RNA, 1701 nt, Artificial Sequence
  derived and/or modified sequence opt5 from hemagglutinin__InfluenzaA__ABG79941
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugcgcgagaacgccgaggacauggggaauggauguuuuaagaucuaucauaaaugcgauaacgcuugcauuggcucuauccggaaugggaccuacgaccacgaugucuacagagacgaagcccucaacaaucgcuuccagauuaagggcguggagcugaaauccggauauaaggacuggauccuuuggaucagcuuugccauuuccuguuuccugcucugcguugugcugcugggcuuuaucaugugggcuugucagaaagggaacauucggugcucuaucuguauuuga

SEQ ID NO: 184109 - RNA, 1701 nt, Artificial Sequence; identical to SEQ ID NO: 183945
  derived and/or modified sequence opt5 from hemagglutinin__InfluenzaA__ABG79952

SEQ ID NO: 184110 - RNA, 1701 nt, Artificial Sequence; identical to SEQ ID NO: 184008
  derived and/or modified sequence opt5 from hemagglutinin__InfluenzaA__ABG79974

SEQ ID NO: 184111 - RNA, 1701 nt, Artificial Sequence; identical to SEQ ID NO: 184008
  derived and/or modified sequence opt5 from hemagglutinin__InfluenzaA__ABG79985

SEQ ID NO: 184112 - RNA, 1701 nt, Artificial Sequence
  derived and/or modified sequence opt5 from hemagglutinin__InfluenzaA__ABG79996
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuauucuugcaagcggggcuccgucaauagcuuuuucucucgccucaacuggcugcacaaacuugaguacaaguaucccgcccugaaugugaccaugccuaacaaugggaaauuugauaagcucuacauuuggggaguucaucacccguccacagacagcgaucaaaccucucuguacgugagagcguccggcaaagucacggugagcacaaagcggucccagcagaccgugauccccgacauuggguaucgcccuugggucagaggacugucuagccggaucuccauuuacuggacaaucguuaagcccggcgacauucuccugaucaacagcaccgggaaccuuaucgccccucgcggauauuucaaaauuagaaauggcaagucuuccaucaugcggagcgaugcucccauuggcaacuguucuagcgagugcaucaccccgaauggguccauuccuaacgacaaacccuuucagaaugugaaccgcaucacauacggagccuguccuagauaugugaagcaaaauacgcugaaacucgcuaccggcaugcggaacguccccgaaaagcagacacgcgggaucuucggagccauugcgggcuuuaucgagaaugggugggaaggaaugguggauggcugguacggcuucagacaccagaacucugaggggaccggacaggccgcugaccugaaaagcacacaagccgcuauugaucagaucaauggcaaacuuaaccggcugguugagaagaccaaugaaaaguuucaucagauugagaaggaguucuccgaaguggaagggagaauccaagaccucgagaaauaugucgaggauacgaagaucgaccuguggagcuacaacgccgaacugcucguggcccuggagaaucagcacacaauugaucuuaccgacucugaaaugaacaaacuguucgagcgcacccggaagcagcucagagaaaacgcugaggauaugggaaauggcugcuuuaagaucuaccauaaaugugacaacgcgugcauuggguccauccgcaauggcacauaugaccacgauguuuaccgggacgaggcccugaacaauagauuccagauuaagggaguggaacuuaaaagcggcuauaaggauuggauccuguggauuucuuuugcuaucuccugcuuccuccugugugucgugcugcucggguuuaucaugugggccugccaaaaaggaaacauucgcuguaauaucugcauuuga

SEQ ID NO: 184113 - RNA, 1701 nt, Artificial Sequence; identical to SEQ ID NO: 184008
  derived and/or modified sequence opt5 from hemagglutinin__InfluenzaA__ABG80007

SEQ ID NO: 184114 - RNA, 1701 nt, Artificial Sequence; identical to SEQ ID NO: 184008
  derived and/or modified sequence opt5 from hemagglutinin__InfluenzaA__ABG80018

SEQ ID NO: 184115 - RNA, 1701 nt, Artificial Sequence; identical to SEQ ID NO: 184013
  derived and/or modified sequence opt5 from hemagglutinin__InfluenzaA__ABG80029

SEQ ID NO: 184116 - RNA, 1701 nt, Artificial Sequence; identical to SEQ ID NO: 184013
  derived and/or modified sequence opt5 from hemagglutinin__InfluenzaA__ABG80040

SEQ ID NO: 184117 - RNA, 1701 nt, Artificial Sequence; identical to SEQ ID NO: 184008
  derived and/or modified sequence opt5 from hemagglutinin__InfluenzaA__ABG80051

SEQ ID NO: 184118 - RNA, 1701 nt, Artificial Sequence
  derived and/or modified sequence opt5 from hemagglutinin__InfluenzaA__ABG80062
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcaucuauuggacaauuguuaagccuggcgacauccugcucaucaauucuaccgggaaccugauugcuccccgcggauacuucaaaaucagaaacggcaaguccagcauuaugcggucugaugccccuaucggcaauuguaacagcgagugcauuacccccaauggguccaucccgaacgacaaaccuuuucaaaaugugaaccgcaucacauauggagcuugucccagauacgugaagcagaauacgcuuaaacuggccaccggcaugcggaacgucccugaaaagcagacacgcgggauuuucggagcgaucgccggcuuuauugagaaugggugggaaggaaugguggauggcugguauggcuucagacaccagaacucugaggggaccggacaagcugccgaccucaaaagcacacaggcugccaucgaucagauuaauggcaagcugaaccggcuuaucgagaagaccaaugaaaaauuucaucaaaucgagaaggaguucuccgaaguugaagggcgcauucaggaccuggagaaauacguggaggauacgaagaucgaccucuggagcuauaacgccgaacugcuggucgcucucgagaaucagcacacaauugaucugaccgacucugaaaugaacaaacuuuucgagagaacccggaagcagcugagagaaaacgcggaggauaugggaaauggcugcuuuaagaucuaccauaaaugugacaacgccugcauuggguccauccgcaauggcacauacgaccacgauguguaucgggacgaggcucucaacaauagauuccaaauuaagggaguugaacugaaaaccggcuacaaggauuggauccuuuggaucagcuuugccauuucuugcuuccugcucugugugguccugcugggguuuaucaugugggccugccagaaaggaaacauucgcuguaauaucugcauuuga

SEQ ID NO: 184119 - RNA, 1701 nt, Artificial Sequence
  derived and/or modified sequence opt5 from hemagglutinin__InfluenzaA__ABG80073
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagaucccaacugcgacggcuuucagaauaaggagugggaucucuucgucgaacgcagcaaagccuauuccaacuguuacccuuaugacgugcccgauuacgcuucucugagaagccuuguugccuccagcgggacgcuggaguuuaccaaugaagacuucaacuggacaggaguggcucaggauggcggcucuuaugccugcaagcggggguccgucaauagcuuuuucucucgccucaacuggcugcauaaacuugaguacaaguauccugcgcugaaugugaccaugcccaacaauggaaaguuugacaaacucuacauuuggggcguucaccauccuuccacagauagcgaccaaaccucucuguacgugagagccuccgggcgggucacggugagcacaaagcgcucccagcagaccgugacaccgaacaucggaucuagacccuggguccggggccugagcucccgcauuagcaucuauuggaccauuguuaaaccuggggacauccuccugauuaacucuaccggaaaucuuaucgcucccagaggcuacuucaagauccggaacggcaaguccagcauuaugcgcucugaugccccuaucgggacauguagcuccgagugcauuacgcccaauggaucuaucccgaacgacaaaccuuuucagaaugugaacagaauuaccuauggcgcuuguccccgguacgugaagcaaaauacacugaaacucgccaccgggaugcgcaacgucccugaaaagcagacaagaggaaucuucggcgcgaucgccggguuuauugagaauggaugggaaggcaugguggauggcugguauggguuccggcaccagaacagcgagggaaccggccaggcugccgaccugaaauccacgcaagcugccaucgaucagauuaaugggaaacuuaacagacugaucgagaagacaaaugaaaaguuucaccagauugagaaggaguucagcgaaguugaaggacgcauccaagaccucgagaaauacguggaggauaccaagaucgaccuguggucuuauaacgccgaacugcucgucgcucuggagaaucagcauaccauugaucuuacagacuccgaaaugaacaaacuguucgagaagacccggaaacagcucagagaaaacgcggaggauaugggcaaugggugcuuuaagaucuaccacaagugugacaacgccugcauuggcagcauccgcaauggaacauacgaccaugauguguaucgggacgaggcucugaacaauagauuccagauuaaaggcguugaacuuaagucuggguacaaagauuggauccuguggauuuccuuugccaucagcugcuuccuccugugugugguccugcucggauuuaucaugugggccugccaaaagggcaacauucgcuguaauaucugcauuuga

SEQ ID NO: 184120 - RNA, 1701 nt, Artificial Sequence
  derived and/or modified sequence opt5 from hemagglutinin__InfluenzaA__ABG80084
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagcggcauuuccaucuauuggaccauuguuaagccuggggacauccuccugaucaacagcacaggaaaccuuauugcuccccgcggcuacuuuaagaucagaaauggcaaaucuuccauuaugcggagcgaugccccuaucgggaacuguucuagcgagugcauuacccccaauggauccaucccgaacgacaagccuuuccagaaugugaaccgcaucaccuauggcgcuugucccagauacgugaaacaaaauacacugaagcucgccacggggaugcggaacgucccugaaaaacagacccgcggaauuuuuggcgcgaucgccggguucauugagaauggaugggaaggcaugguggauggcugguauggguuuagacaccagaacucugagggaacaggccaggcugccgaccuuaagagcacccaagcugccaucgaucagauuaaugggaaacugaaccggcugaucgagaagacaaaugaaaaguuccaucagaucgagaaagaguucuccgaaguugaaggacgcauucaagaccucgagaaguacguggaggauaccaaaaucgaccuguggagcuauaacgccggccugcucgucgcucuggaaaaucagcacacgauugaucuuacagacucugagaugaacaagcuguuugaaagaacccggaaacagcucagagagaacgcggaagauauggggaauggcugcuucaagaucuaccauaagugugacaacgccugcauuggauccauccgcaauggcaccuacgaccacgauauuuaucgggacgaggcucugaacaauagauuucagaucaaagggguggagcuuaagagcggauacaaagauuggauccuguggauuucuuucgccaucuccugcuuucuccuguguguugugcugcucggcuucauuaugugggccugccaaaaggggaacauccgcuguaauauuugcaucuga

SEQ ID NO: 184121 - RNA, 1701 nt, Artificial Sequence
  derived and/or modified sequence opt5 from hemagglutinin__InfluenzaA__ABG80095
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaaguugacaagcucuacaucuggggagugcaucacccuuccaccgauagcgaccaaacaucucuguacgucagagccuccggccgggugaccgugagcacgaaacgcucccagcagacagucauuccgaauaucggguuuagacccuggguucggggacugucuagccgcauuuccaucuauuggaccauugugaagccuggcgacauccuccugaucaacagcacagggaaccuuauugcucccagaggauacuucaagauccggaauggcaaaucuuccauuaugcgcagcgaugccccuaucggcaacuguucuagcgagugcauuacccccaauggguccaucccgaacgacaagccuuuucagaaugugaacagaaucaccuauggagcuuguccccgguacgucaaacaaaauacacugaagcucgccacgggcaugcgcaacgugccugaaaaacagaccagagggauuuucggagcgaucgccggcuuuauugagaaugggugggaaggaaugguugauggcugguauggcuuccggcaccagaacucugaggggacaggacaggcugccgaccuuaagagcacccaagcugccaucgaucagauuaauggcaaacugaacagacugaucgagaagacaaaugaaaaguuucaucagaucgagaaagaguucuccgaaguggaagggcgcauucaagaccucgagaaguacgucgaggauaccaaaaucgaccuguggagcuauaacgccggacugcucguggcucuggaaaaucagcacacgauugaucuuacagacucugagaugaacaagcuguucgaacggaccagaaaacagcuccgcgagaacgcggaagauaugggcaaugggugcuuuaagaucuaccauaagugugacaacgccugcauuggcuccauccggaauggaaccuacgaccacgauguuuauagagacgaggcucugaacaaucgcuuccagauuaaaggcguggagcuuaagagcggguacaaagauuggauccuguggaucucuuuugccauuuccugcuuccuccugugugucgugcugcucggauuuaucaugugggccugccaaaagggcaacauucgguguaauaucugcauuuga

SEQ ID NO: 184122 - RNA, 1701 nt, Artificial Sequence; identical to SEQ ID NO: 184048
  derived and/or modified sequence opt5 from hemagglutinin__InfluenzaA__ABG80106

SEQ ID NO: 184123 - RNA, 1701 nt, Artificial Sequence
  derived and/or modified sequence opt5 from hemagglutinin__InfluenzaA__ABG80117
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugugaaacagaccagagggauuuuuggagcgaucgccggcuucauugaaaaugggugggagggaaugguugauggcugguauggcuuucggcaccagaacucugaagggacaggacaggcugccgaccuuaagagcacccaagcugccaucgaucagauuaauggcaaacugaacagacugaucgagaagacaaaugagaaguuccaucagaucgaaaaagaguucuccgaaguggaggggcgcauucaagaccucgaaaaguacgucgaggauaccaaaaucgaccuguggagcuauaacgccggacugcucguggcucuggagaaucagcacacgauugaucuuacagacucugaaaugaacaagcuguuugagcggaccagaaaacagcuccgcgaaaacgcggaggauaugggcaaugggugcuucaagaucuaccauaagugugacaacgccugcauuggcuccauccggaauggaaccuacgaccacgauguuuauagagacgaagcucugaacaaucgcuuucagauuaaaggcguggagcuuaagagcggguacaaagauuggauccuguggaucucuuucgccauuuccugcuuucuccugugugucgugcugcucggauucaucaugugggccugccaaaagggcaacauucgguguaauaucugcauuuga

SEQ ID NO: 184124 - RNA, 1701 nt, Artificial Sequence
  derived and/or modified sequence opt5 from hemagglutinin__InfluenzaA__ABG80128
augaagaccaucauugcccugagcuacauccucugccugguguucgcucagaaacuucccggcaacgacaauuccacagccacgcugugucucgggcaccaugcggucccuaacggaacccugguuaagacaauuaccaaugauagaaucgaggugacaaacgcuaccgaacuugugcaaucuagcuccacaggccggauuugcgacucuccgcaccgcauccuggaugggaaaaauuguacccucaucgacgcccugcugggagauccccauugcgacggcuuucagaacaaggagugggaucucuucgucgaaagaagcaaagccuauuccaauuguuacccuuaugacgugcccgauuacgcuucucugcggagccuuguugccuccagcgggacgcuggaguuuauuaacgaagacuucaauuggaccggaguggcucaggauggcaagucuuaugccugcaagcgcggcuccgucaacagcuuuuucucuagacucaauuggcugcacaaacuugaguacaaguauccugcgcugaacgugacaaugcccaauaacgggaaauuugacaagcucuacaucuggggaguucaucacccuuccaccgauagcgaccagacaucucuguacgugcgggccuccggccgcgucaccgugagcacgaaaagaucccaacagacagugauuccgaauaucggguuccggcccuggguccgcggacugucuagcagaauuuccaucuauuggaccauuguuaagccuggcgacauccuccugaucaacagcacagggaaccuuauugcuccccggggauacuuuaagauccgcaauggcaaaucuuccauuaugagaagcgaugccccuaucggcaacuguucuagcgagugcauuacccccaauggguccaucccgaacgacaagccuuuccagaaugugaaccggaucaccuauggagcuuguccccgcuacgugaaacagaauacacugaagcucgccacgggcaugagaaacgucccugaaaaacaaacccgggggauuuuuggagcgaucgccggcuucauugagaaugggugggaaggaaugguggauggcugguauggcuuuagacaccagaacucugaggggacaggacaggcugccgaccuuaagagcacccaggcugccaucgaucaaauuaauggcaaacugaaccgccugaucgagaagacaaaugaaaaguuccaucagaucgagaaagaguucuccgaaguugaagggcggauucaggaccucgagaaguacguggaggauaccaaaaucgaccuguggagcuauaacgccggacugcucgucgcucuggaaaaucaacacacgauugaucuuacagacucugagaugaacaagcuguuugaaagaacccgcaaacagcuccgggagaacgcggaagauaugggcaaugggugcuucaagaucuaccauaagugugacaacgccugcauuggcuccaucagaaauggaaccuacgaccacgauguguaucgcgacgaggcucugaacaaucgguuucagauuaaaggcguugagcuuaagagcggguacaaagauuggauccuguggaucucuuucgccauuuccugcuuucuccugugugugguccugcucggauucaucaugugggccugccagaagggcaacauuagauguaauaucugcauuuga

SEQ ID NO: 184125 - RNA, 1701 nt, Artificial Sequence
  derived and/or modified sequence opt5 from hemagglutinin__InfluenzaA__ABG80139
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuuaugagugcauuacccccaaugggagcaucccgaacgacaagccuuuccagaaugugaacagaaucaccuacggagcuuguccccgguaugugaaacaaaauacacugaagcucgccacgggcaugcgcaacgucccugaaaaacagaccagagggauuuuuggagcgaucgccggcuucauugagaaugggugggaaggaaugguggauggcugguacggcuuucggcaccagaacuccgaggggacaggacaggcugccgaccugaagucuacccaagcugccaucgaucagauuaauggcaaacuuaacagacugaucgagaagacaaaugaaaaguuccaucagaucgagaaagaguucagcgaaguugaagggcgcauucaagaccucgagaaguauguggaggauaccaaaaucgaccugugguccuacaacgccggacugcucgucgcucuggaaaaucagcacacgauugaucuuacagacagcgagaugaacaagcuguuugaacggaccagaaaacagcuccgcgagaacgcggaagauaugggcaaugggugcuucaagaucuaccauaagugugacaauaccugcauuggcucuauccggaacggaacauaugaccacgauguguacagagacgaggcccugaacaaucgcuuucagauuaaaggcguugagcuuaaguccggguauaaagauuggauccuguggaucagcuucgcuauuucuugcuuucuccugugugugguccugcucggauucaucaugugggccugccaaaagggcaacauucgguguaauaucugcauuuga

SEQ ID NO: 184126 - RNA, 1701 nt, Artificial Sequence
  derived and/or modified sequence opt5 from hemagglutinin__InfluenzaA__ABG80150
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaaaauuucaacuggaccggaguggcucaggacggcaagucuuaugccugcaagcggggcuccgucaauagcuuuuucucucgccucaacuggcugcacaaacuugaguacaaguauccugcgcugaaugugacaaugcccaacaaugggaaauuugauaagcucuacaucuggggaguucaucacccuuccaccgacagcgaucaaacaucucuguacgugagagccuccggccgggucaccgugagcacgaaacgcucccagcagacagugauuccgaacaucggguucagacccuggguccggggacugucuagcggcauuuccaucuauuggaccauuguuaagccuggggacauccuccugaucaacagcacaggaaaucuuauugcuccccgcggcuacuuuaagaucagaaacggcaaaucuuccauuaugcggagcgacgccccuaucgggaauuguucuagcgagugcauuacccccaacggauccaucccgaaugauaagccuuuccagaacgugaaucgcaucaccuauggcgcuugucccagauacgugaaacaaaacacacugaagcucgccacggggaugcggaaugucccugaaaaacagacccgcggaauuuuuggcgcgaucgccggguucauugagaacggaugggaaggcaugguggacggcugguauggguuuagacaccagaauagcgagggaacaggccaggcugccgaucugaagucuacccaagcugccaucgaccagauuaacgggaaacuuaaucggcugaucgagaagacaaacgaaaaguuccaucagaucgagaaagaguucuccgaaguugaaggacgcauucaagaucucgagaaguacguggaggacaccaaaaucgaucuguggagcuauaaugccggccugcucgucgcucuggaaaaccagcacacgauugaccuuacagauucugagaugaacaagcuguuugaaagaacccggaaacagcucagagagaaugcggaagacauggggaacggcugcuucaagaucuaccauaagugugauaaugccugcauuggauccauccgcaacggcaccuacgaccacgacguguaucgggaugaggcucugaauaacagauuucagauuaaagggguugagcuuaagagcggauacaaagacuggauccuguggaucucuuucgccauuuccugcuuucuccugugugugguccugcucggcuucaucaugugggccugccaaaaggggaauauucgcuguaacaucugcauuuga

SEQ ID NO: 184127 - RNA, 1701 nt, Artificial Sequence
  derived and/or modified sequence opt5 from hemagglutinin__InfluenzaA__ABG80161
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacaaggagugggaucuguucgucgaacgcuccaaagccuauucuaauuguuacccuuaugacgugcccgauuacgcuagccucagaucccugguugccagcucugggacgcuugaguuuauuaacgaagacuucaauuggaccggaguggcucaggauggcaaguccuaugccugcaagcggggcagcgucaacucuuucuucucccgccugaauuggcuccacaaacuggaguacaaguauccugcgcuuaacgugacaaugcccaauaacgggaaauuugacaagcuguacaucuggggaguucaucacccuagcaccgauucugaccaaacaucccucuacgugcaggccagcggcagagucaccguguccacgaaacggucucagcagacagugauuccgaauaucggguuccgccccugggucagaggacugagcucccggauuagcaucuauuggaccauuguuaagccuggcgacauccugcucaucaacucuacagggaaccugauugcuccccgcggauacuuuaagaucagaaauggcaaauccagcauuaugcggucugaugccccuaucggcaacuguagcuccgagugcauuacccccaaugggucuaucccgaacgacaagccuuuccaaaaugugaaccgcaucaccuauggagcuugucccagauacgugaaacagaauacacuuaagcuggccacgggcaugcggaacgucccugaaaaacagacccgcgggauuuuuggagcgaucgccggcuucauugagaaugggugggaaggaaugguggauggcugguauggcuuuagacaccagaacagcgaggggacaggacaagcugccgaccucaaguccacccaggcugccaucgaucagauuaauggcaaacugaaccggcuuaucgagaagacaaaugaaaaguuccaucaaaucgagaaagaauuuagcgagguugaagggcgcauucaggaccuggagaaguacguggaggauaccaaaaucgaccucuggucuuauaacgccggacugcuggucgcucucgaaaaucagcacacgauugaucugacagacuccgagaugaacaaacuuuuugaaagaacccggaagcagcugagagagaacgcggaagauaugggcaaugggugcuucaagaucuaccauaagugugacaacgccugcauuggcagcauccgcaauggaaccuacgaccacgauguguaucgggacgaggcucucaacaauagauuucaaauuaaaggcguugagcugaagucuggguacaaagauuggauccuuuggaucuccuucgccauuagcugcuuucugcucugugugguccugcugggauucaucaugugggccugccagaagggcaacauucgcuguaauaucugcauuuga

SEQ ID NO: 184128 - RNA, 1698 nt, Artificial Sequence
  derived and/or modified sequence opt5 from hemagglutinin__InfluenzaA__ABG80172
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacuccgugaucgaaaagaugaauacacaguuuaccgcuguugggaaagaguucaacaaacuggagagacggauggaaaaucucaacaagaagguggacgauggauuccuggacauuuggacauauaacgcggagcuucugguccuccuggaaaaugagcgcacccuugacuuucacaacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaauagagagaaaauugacggaguuaagcuggaauccaugggcguguaucagauccucgcuauuuacagcacagucgccuccucucuggugcuucugguuagccucggggccaucuccuucuggaugugcucuaacggaagccugcagugucggaucugcauuuga

SEQ ID NO: 184129 - RNA, 1698 nt, Artificial Sequence
  derived and/or modified sequence opt5 from hemagglutinin__InfluenzaA__ABG80183
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgggcagagagcccuguaccacacagaaaacgcuuaugugagcgucguuuccucucauuacagccggcgcuucacccccgagauugccaaaagaccuaaggugcgggaucaggaaggacgcaucaauuauuacuggacgcuucuggagcccggcgacacaauuaucuuugaggcgaacgggaaucucauugccccuagauaugcuuucgcccugucccggggauuuggcagcggcaucauuaccucuaacgcucccauggaugaaugugacgccaagugccagacaccgcaaggggcgaucaauuccagccuuccuuuccagaacgugcaccccgucaccaucggagaguguccuaaauacgugcgcucugccaagcugagaaugguuaccggccuccggaauauucccagcauccagucccgcgggcuguuuggagcuauugccggcuucaucgaagggggauggacaggcaugguggauggcugguauggguaccaucaccagaacgagcaaggaucuggcuacgcugccgaccagaaaagcacgcagaaugccauuaacgggaucaccaauaaggucaacuccgugaucgaaaagaugaauacacaguuuaccgcuguuggaaaagaguucaacaaacuggagagacggauggaaaaucucaacaagaagguggaugacggcuuccuggauauuuggacauauaacgcggagcuucugguccuccuggaaaaugagcgcacccuugacuuucacgacagcaacgugaaaaaucuguacgaaaaggucaaaucucaacucaagaacaaugccaaagagaucgggaacggcugcuucgaguuuuaucauaaguguaauaacgaaugcauggaguccgugaagaauggaacguacgauuaucccaaauacagcgaagagucuaagcugaacagagagaaaauugacggcguuaagcuggaauccauggggguguaucagauccucgcuauuuacagcacagucgccuccucucuggugcuucugguuagccucggagccaucuccuucuggaugugcucuaauggcagccugcagugucggaucugcauuuga

SEQ ID NO: 184130 - RNA, 1701 nt, Artificial Sequence
  derived and/or modified sequence opt5 from hemagglutinin__InfluenzaA__ABG80194
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaauggaaucucuucguggagcggagcacggccuauuccaacuguuacccuuaugauguucccgacuacgcuucucugcgcagccuuguggccuccagcggcacccuggaauuuaauaacgagucuuucaauuggacaggggucgcucagaacggaaccuccagcgccugcaagagacggucuauuaaauccuuuuucagccgccucaauuggcugcaucaacuuaaguauaaguacccugcgcugaacgugacaaugcccaauaacgagaaauuugauaagcucuauaucuggggcguucaccacccuucuaccgacuccgaucagauuagccuguacgcccaggcuuccggcagagugacggucucuacaaaacggagccagcaaaccgugaucccgaacauugggucccgccccugggugagaggagucagcucuaucauuuccaucuacuggacaaucguuaagccuggcgacauucugcucaucaauagcaccgggaaccugauugcuccccggggauauuucaaaauccgcucuggcaagagcuccauuaugagaucuaaugccccuaucgggaaguguaacagcgaaugcaucacccccaauggauccauuccgaacgauaaaccuuuucagaaugugaaccggaucacauacggcgccuguccccgcuaugugaagcagaauacgcuuaaacuggcgaccggcaugagaaacgucccugagaagcagacacgggggauuuucggagccaucgcuggcuuuauugaaaaugggugggagggaaugguggacggcugguacggguuccgccaucaaaacagcgagggaaccggccaggccgcugaccucaaaucuacacaggccgccaucaaucaaaucaacggcaagcugaauagacuuauugagaaaaccaacgaaaaguuucaccagaucgaaaaggaguucuccgaaguugaggggcggauucaggaucuggagaaauauguggaagacacgaagaucgaucucuggagcuacaacgcugagcugcuggucgcgcucgaaaaucagcauacaauugaccugaccgauucugagaugaacaaacuuuucgaaagaacccgcaagcaacugcgggagaaugccgaggacaugggaaacggcugcuuuaaaaucuaucacaagugugauaaugcuugcauuggguccaucagaaacggaacauacgaccacgauguguaccgcgacgaagcccucaauaaccgguuccagaucaagggcguugagcugaaaagcggguauaaggauuggauucuuuggaucuccuuugccauuucuugcuuccugcucugugugguccugcugggcuuuaucaugugggcuugccagaaaggaaauauuagauguaacaucugcaucuga

SEQ ID NO: 184131 - RNA, 1701 nt, Artificial Sequence
  derived and/or modified sequence opt5 from hemagglutinin__InfluenzaA__ABG80205
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucgccaugcccaauaacgagaaguuugacaaacucuauauuuggggagugcaucacccuucuaccgauuccgaccagaucagccuguacgcucaggccccggggcgcguuacaguguccaccaagagaucucaacagacggucauucccaacaucggcagccggccuugggugcgcgggguguccagcagaauuucuaucuacuggacaauugucaaacccggagauauccugcucaucaauuguaccggcaaccugauugcuccucggggguauuucaagauccgcuccggaaagagcucuauuaugagaagcgacgccuccaucggcaaaugcaauucugaauguauuacacccaacggcagcaucccgaaugacaagccuuuucagaacguuaaucggaucaccuacggggcgugcccccgcuaugugaaacagaacacccuuaagcuggccacaggaaugagaaaugugccugagaaacaaacgcggggcauuuucggggcuaucgccggauuuauugaaaacggcugggaggggauggucgauggaugguacggcuuccgccaccaaaauuccgagggcaccgggcaggcugccgaccucaagagcacacaggccgcuaucaaccagauuaauggaaaacugaacagacuuaucgaaaagaccaaugagaaguuucaucagaucgaaaaagaguucucugaaguggagggccggauucaggaucuggagaaguauguugaagacacaaaaaucaaccucugguccuacaacgcggagcugcugguggcccucgaaaaucaacacaccauugaucugacggacagcgagaugaacaaacuuuucgaaagaacaaagaagcagcugcgcgagaaugcugaggauauggggaacggauguuuuaagaucuaucauaaaugcgacaaugccugcauuggcucuauccggaacgggaccuacgaucacgacgucuacagagaugaagcccucaauaaccgcuuccagauuaagggcguggagcugaaauccggauauaaggacuggauccuuuggaucagcuuugcuauuuccuguuuccugcucugcguugugcugcugggcuuuaucaugugggccugucagaaagggaauauucggugcaacaucuguauuuga

SEQ ID NO: 184132 - RNA, 1701 nt, Artificial Sequence
  derived and/or modified sequence opt5 from hemagglutinin__InfluenzaA__ABG80216
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcccgacaggaagaauuugcgacucuccccaucagauccuggauggcgagaauuguacccucaucgacgcccugcugggggauccucacugcgacggauuucagaacaaagaaugggaucucuucguggagcggucuacggccuauagcaauuguuaccccuaugacguuccugauuacgcuucccugcgcucucuuguggccagcuccggcacccuggaauuuaacaaugagagcuucaacuggacaggggucgcucagaauggaaccucuuccgccugcaagagacggagcauuaaauccuuuuucucccgccucaacuggcugcaucaacuuaaguauaaguaccccgcgcugaaugugacaaugccuaacaaugagaaauuugacaagcucuauaucuggggcguucaccacccgagcaccgauucugaccagauuucccuguacgcccaggcucccggcagagugacggucagcacaaaacggucccagcaaaccgugaucccuaacauugggucucgccccugggugagaggagucagcucccggaucagcauuuacuggacaaucguuaagccuggcgauauccugcucauuaacucuaccgggaaucugaucgcuccccgcggauauuucaaaauuagauccggcaagagcucuaucaugcggagcaacaccccgauugggaaguguaauuccgaaugcaucacaccuaacggaucuauccccaaugacaaaccuuuucagaacgugaaucgcauuacguacggcgccugucccagauaugugaagcagaacacccuuaaacuggccacaggcaugcggaauguccccgagaagcagacccgcgggaucuucggagcgauugccggcuuuaucgaaaacgggugggagggaaugguggacggcugguacggguucagacaucaaaauagcgagggaacaggccaggcugccgaucucaaauccacccaggcugccauuaaccaaaucaauggcaagcugaaccggcuuaucgagaaaacgaaugaaaaguuucaccagauugaaaaggaguucagcgaaguugaggggagaauccaggaccuggagaaauauguggaagauacaaagauugaccucuggucuuacaacgccgagcugcuggucgcucucgaaaaccagcauaccaucgaucugaccgacuccgagaugaauaaacuuuucgaacgcacacggaagcaacugagagagaacgcggaggauaugggaaauggcugcuuuaaaauuuaucacaagugugacaacgccugcaucgggagcauucgcaauggaaccuacgaucacgacguguaccgggaugaagcucucaacaauagauuccagaucaagggcguugagcugaaaucuggguauaaggacuggauccuuuggauuuccuuugccaucagcugcuuccugcucugugugguccugcugggcuuuauuaugugggccugccagaaaggaaacauccgcuguaauauuugcaucuga

SEQ ID NO: 184133 - RNA, 1701 nt, Artificial Sequence; identical to SEQ ID NO: 183664
  derived and/or modified sequence opt5 from hemagglutinin__InfluenzaA__ABG80227

SEQ ID NO: 184134 - RNA, 1701 nt, Artificial Sequence; identical to SEQ ID NO: 183540
  derived and/or modified sequence opt5 from hemagglutinin__InfluenzaA__ABG80238

SEQ ID NO: 184135 - RNA, 1701 nt, Artificial Sequence; identical to SEQ ID NO: 183540
  derived and/or modified sequence opt5 from hemagglutinin__InfluenzaA__ABG80249

SEQ ID NO: 184136 - RNA, 1701 nt, Artificial Sequence; identical to SEQ ID NO: 183540
  derived and/or modified sequence opt5 from hemagglutinin__InfluenzaA__ABG80260

SEQ ID NO: 184137 - RNA, 1701 nt, Artificial Sequence
  derived and/or modified sequence opt5 from hemagglutinin__InfluenzaA__ABG80271
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgggauuugcgacucuccgcaccagauccuugauggagagaauuguacccugauggacgcccuccugggcgauccccagugcgacggguuucaaaacaaaaagugggaucuguucguggaaagaagcaaagccuauuccaauuguuacccuuaugacguucccgauuacgcuucucuccggagccugguggccuccagcggaacgcuugaguuuaacaaugaaucuuucaacuggaccggcgucacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacaucuggggaguucaccauccugggacggauaaugaccagauuucucucuaugcgcaggccuccggccgcaucacagugagcaccaagagaucccaacagacagucauuccgaacaucgggucucggccccgcgugagagauauuccuagccggaucuccauuuacuggaccaucgugaaacccggagacauccugcugauuaauagcaccggcaaccucaucgcuccucgcggguacuuuaagauuagaucuggaaaguccagcaucaugcggucugacgcccccauuggcaaauguaauagcgagugcaucacaccgaacggcuccaucccuaaugauaagcccuuccagaacgucaaucgcauuacguauggggcuuguccuagauacguuaaacagaacacccugaaacuugccacaggaaugcggaaugugcccgaaaaacaaacccgcggcaucuuuggggcgauugccggauucaucgagaacggcugggaagggaugguggacggaugguauggcuuuagacaccagaauagcgagggcacagggcaggcugccgaucugaagucuacccaagcugccauuaaccagaucaauggaaaacucaaccggcugaucggcaagacgaacgagaaguuccaccagauugaaaaagaguucuccgaagucgaggggagaauccaggaccuugaaaaguacguggaggauacaaaaauugaccuguggagcuauaaugccgagcuccugguugcucuggaaaaccaacauaccaucgaucucaccgacucugagaugaauaagcuguuugaacgcacaaagaagcagcuucgggagaacgcggaagauaugggaaauggcugcuucaagauuuaccacaaaugugacaacgccugcaucggguccauuagaaauggcaccuaugaucaugacguguaccgcgacgaggcucugaacaaucgguuucagaucaagggagucgagcucaaaagcggcuacaaggauuggauccuguggauuucuuucgccaucuccugcuuucuucuguguguggcccuccugggguucauuaugugggcuugccagaaaggaaacaucagauguaauauuugcaucuga

SEQ ID NO: 184138 - RNA, 1701 nt, Artificial Sequence; identical to SEQ ID NO: 183615
  derived and/or modified sequence opt5 from hemagglutinin__InfluenzaA__ABG80282

SEQ ID NO: 184139 - RNA, 1701 nt, Artificial Sequence; identical to SEQ ID NO: 183267
  derived and/or modified sequence opt5 from hemagglutinin__InfluenzaA__ABG80293

SEQ ID NO: 184140 - RNA, 1701 nt, Artificial Sequence
  derived and/or modified sequence opt5 from hemagglutinin__InfluenzaA__ABG80304
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuaaucucuaugcgcaggccucuggccgcaucacaguuuccaccaagagaagccaacagacagugauuccgaacaucgggucccggccccgcgucagagacauuccuucucggaucagcaucuacuggaccauugugaaacccggagauauccugcugauuaauuccaccggcaaccucaucgcuccucgcggguacuuuaagauuagaagcggaaagucuuccaucaugcggagcgacgcccccaucggcaaauguaauucugagugcauuacaccgaacggcagcaucccuaaugacaagcccuuccagaacgugaaucgcauuacguauggggcuuguccuagauacgucaaacagaacacccugaaacuugccacaggaaugcggaauguucccgaaaagcaaacccgcggcaucuuuggggcgauugccggauucaucgagaacggcugggaagggaugguggauggaugguauggcuuuagacaccaaaauuccgagggcaucgggcaggcugccgaccugaagucuacacaggcugccauuaaccagaucaacggaaaacucaaucggcugauuggcaagaccaacgagaaguuccaccagaucgaaaaagaguucagcgaaguggaggggcgcauucaggaucuugaaaaguacgucgaggacacgaaaaucgaucugugguccuauaaugccgagcuccugguggcucuggaaaaccaacauacaauugaccucaccgauagcgagaugaauaagcuguuugaaagaaccaaaaagcagcuucgggagaacgcggaagacaugggaaauggcugcuucaagaucuaccacaaaugugauaacgccugcaucgggucuauuagaaauggcacauaugaccaugauguuuaccgcgacgaggcucugaacaaucgguuucagaucaagggaguggagcucaaauccggcuacaaggacuggauucuguggaucagcuucgccauuucuugcuuucuucugugugucgcccuccugggguucaucaugugggcuugccagaaaggaaacaucagauguaauauuugcaucuga

SEQ ID NO: 184141 - RNA, 1701 nt, Artificial Sequence
  derived and/or modified sequence opt5 from hemagglutinin__InfluenzaA__ABG80315
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacugauccagucuagcuccacaggcgggaucugcgacucuccgcaccagauucuugauggagagaauuguacccugaucgacgcccuccugggcgauccccagugcgacggguuucaaaacaaaaagugggaucuguucguggaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucccuagccggaucuccauuuacuggaccaucgucaaacccggagacaugcugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgugaaacagaacacccugaaacuugccacaggaaugcggaauguccccgaaaaacaaacccgcggcaucuuuggggcgauugccggauucaucgagaacggcugggaagggaugguugacggaugguauggcuuuagacaccagaauagcgagggcacagggcaggcugccgaucugaagucuacccaagcugccaucaaccagauuaauggaaaacucaaccggcugaucggcaagacgaacgagaaguuccaccagauugaaaaagaguucuccgaaguggaggggagaauccaggaccuugaaaaguacguggaggauacaaaaauugaccuguggagcuauaaugccgagcuccuggucgcucuggaaaaccaacauaccaucgaucucaccgacucugagaugaauaagcuguuugaacgcacaaagaagcagcuucgggagaacgcggaagauaugggaaauggcugcuucaagauuuaccacaaaugugacaacgccugcaucggguccaucagaaauggcaccuaugaucaugacguguaccgcgacgaggcucugaacaaucgguuucagauuaagggaguugagcucaaaagcggcuacaaggauuggauccuguggauuucuuucgccaucuccugcuuucuucuguguguggcccuccugggguucauuaugugggcuugccagaaaggaaacaucagauguaauaucugcauuuga

SEQ ID NO: 184142 - RNA, 1701 nt, Artificial Sequence; identical to SEQ ID NO: 183306
  derived and/or modified sequence opt5 from hemagglutinin__InfluenzaA__ABG80326

SEQ ID NO: 184143 - RNA, 1701 nt, Artificial Sequence; identical to SEQ ID NO: 183306
  derived and/or modified sequence opt5 from hemagglutinin__InfluenzaA__ABG80337

SEQ ID NO: 184144 - RNA, 1701 nt, Artificial Sequence
  derived and/or modified sequence opt5 from hemagglutinin__InfluenzaA__ABG80359
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauaacggaaaguuugacaaacucuacaucuggggcguucaucacccuuccaccgauagcgaccaaacaucucuguacgugagagccuccgggcgggucaccgugagcacgaagcgcucccagcagacagugaccccgaauauuggaucuagacccuggguccggggccugagcucccgcaucagcauuuauuggacaaucguuaaaccuggggacauucuccugaucaacucuaccggaaaccuuaucgcucccagaggcuacuucaagauucggaauggcaaguccagcaucaugcgcucugaugccccuauugggaacuguagcuccgagugcaucacccccaauggaucuauuccgagcgacaaaccuuuucagaacgugaauagaaucacauauggcgcuuguccccgguacgugaagcaaaacacgcugaaacucgccaccgggaugcgcaaugucccugaaaagcagacaagaggaaucuucggcgcgauugccggguuuaucgagaacggaugggaaggcaugguggauggcugguauggguuccggcaccaaaauuccgagggaaccggccaggcugccgaccugaaaagcacacaggcugccguugaucagauuaacgggaaacuuaauagacugaucgagcgcaccaacgaaaaguuucaucagauugagaaggaguucucugaaguggaaggacggauccaagaccucgagaaguacgucgaggauacgaaaaucgaccugugguccuauaaugccgaacugcucguggcucuggagaaccagcacacaauugaucuuaccgacagcgaaaugaauaagcuguucgagaaaaccagaaagcagcuccgcgaaaacgcggaggauaugggcaacgggugcuuuaaaaucuaccauaagugugacaaugccugcauuggcucuauccggaacggaacauacgaccacgauguuuauagagacgaggcucugaauaaccgcuuccagauuaagggcguggaacuuaaauccggguacaaggauuggauccuguggauuagcuuugccaucuccugcuuccuccugugugucgugcugcucggauuuaucaugugggccugccaaaaaggcaauauucgguguaacaucugcauuuga

SEQ ID NO: 184145 - RNA, 1701 nt, Artificial Sequence
  derived and/or modified sequence opt5 from hemagglutinin__InfluenzaA__ABG80370
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaagagcuuuuucucucgccucaacuggcugcacaaacuugaguacaaauauccugcgcugaaugugacaaugcccaacaaugggaaguuugacaaacucuacaucuggggaguucaucacccuuccaccgauagcgaccaaacaucucuguacgugagagccuccggccgggucaccgugagcacgaagcgcucccagcagacagugauuccgaacaucgggucuagacccuggguccggggacugagcucccgcauuagcaucuauuggaccauuguuaagccuggcgacauccuccugaucaauucuacagggaaccuuauugcucccagaggauacuucaaaauccggaacggcaaguccagcauuaugcgcucugaugccccuaucggcaauuguagcuccgagugcauuacccccaacgggucuaucccgaaugacaaaccuuuucagaacgugaauagaaucaccuauggagcuuguccccgguacgugaagcaaaacacacugaaacucgccacgggcaugcgcaaugucccugaaaagcagaccagagggauuuucggagcgaucgccggcuuuauugagaacgggugggaaggaaugguggauggcugguauggcuuccggcaccagaauagcgaggggacaggacaggcugccgaccugaaauccacccaagcugccaucgaucagauuaacggcaaacuuaauagacugaucgagaagacaaacgaaaaguuucaucagaucgagaaggaguucagcgaaguugaagggcgcauucaagaccucgagaaauacguggaggauaccaagaucgaccuguggucuuauaaugccgaacugcucgucgcucuggagaaccagcacacgauugaucuuacagacuccgaaaugaauaaacuguucgagcggaccagaaagcagcuccgcgaaaacgcggaggauaugggaaacggcugcuuuaagaucuaccauaaaugugacaaugccugcauugggagcauccggaacggcaccuacgaccacgauguguauagagacgaggcucugaauaaccgcuuccagauuaagggaguugaacuuaaaucuggcuacaaggauuggauccuguggaucuccuuugccauuagcugcuuccuccugugugugguccugcucggguuuaucaugugggccugccaaaaaggaaauauucgguguaacaucugcauuuga

SEQ ID NO: 184146 - RNA, 1701 nt, Artificial Sequence; identical to SEQ ID NO: 184077
  derived and/or modified sequence opt5 from hemagglutinin__InfluenzaA__ABG80392

SEQ ID NO: 184147 - RNA, 1701 nt, Artificial Sequence; identical to SEQ ID NO: 184077
  derived and/or modified sequence opt5 from hemagglutinin__InfluenzaA__ABG80403

SEQ ID NO: 184148 - RNA, 1701 nt, Artificial Sequence; identical to SEQ ID NO: 184077
  derived and/or modified sequence opt5 from hemagglutinin__InfluenzaA__ABG80414

SEQ ID NO: 184149 - RNA, 1701 nt, Artificial Sequence; identical to SEQ ID NO: 184077
  derived and/or modified sequence opt5 from hemagglutinin__InfluenzaA__ABG80425

SEQ ID NO: 184150 - RNA, 1701 nt, Artificial Sequence; identical to SEQ ID NO: 183807
  derived and/or modified sequence opt5 from hemagglutinin__InfluenzaA__ABG88289

SEQ ID NO: 184151 - RNA, 1701 nt, Artificial Sequence
  derived and/or modified sequence opt5 from hemagglutinin__InfluenzaA__ABG88300
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccgaucugucuaaguccuacgugaauaacaaagagaaggaaguucucgugcuguggggaguccaucacccuagcaauauuggggaccagagagccaucuaccacaccgagaacgcguauguguccguggucucuagccauuacucccggcgcuuuacgccggaaaucacaaagagacccaaaguucgggaucaggagggccgcauuaacuauuacuggacccugcucgagccuggggacacaaucauuuucgaagccaauggaaaccugaucgcucccugguaugccuuugcucuuagcagaggcuucgggucuggaauuaucaccuccaaugccagcaugggcgagugugaugcgaagugccagaccccucaaggcgccauuaacucuagccugcccuuucagaaugugcacccggugacaaucggggaauguccuaaauacguccgguccacgaagcuccgcauggugaccggacugagaaacauccccucuauucagagccggggccuuuucggggcuaucgccggauuuauugagggcggguggacaggaaugaucgacggcugguauggcuaccaucaccagaaugaacaaggguccggauacgcugccgaucagaaaagcacccagaacgccauugacggcaucacaaauaagguuaacucugugaucgagaaaaugaauacccaguucacggcugucgggaaggaguucaacaagcuggaacgcagaauggagaaucucaacaaaaagguggaugacggauuucuggacauuuggacauauaaugcggaacugcucguucugcuugagaacgaacggacccuggauuuccacgacuccaacgugaaaaaucucuacgagaaggucaaaacccaacugaagaacaaugccaaggagaucggcaacgggugcuuugaguucuaucauaaauguaauaacgaaugcauggaaagcgugaagaauggcacauacgauuauccuaaauacucugaggaguccaaacuuaaccgcgagaaaauugacggagucaagcuggaaagcaugggcguguaucagauccucgcuauuuacuccaccguugccucuagccuggugcugcucgucucccugggggccaucucuuuuuggaugugcagcaauggaucccuucaguguagaaucugcauuuga

SEQ ID NO: 184152 - RNA, 1701 nt, Artificial Sequence; identical to SEQ ID NO: 183935
  derived and/or modified sequence opt5 from hemagglutinin__InfluenzaA__ABG88311

SEQ ID NO: 184153 - RNA, 1701 nt, Artificial Sequence
  derived and/or modified sequence opt5 from hemagglutinin__InfluenzaA__ABG88322
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccauucugucuaaguccuacgugaauaacaaagagaaggaaguucucgugcuguggggaguccaucacccuagcaauaucggggaucagagagccaucuaccacaccgagaacgcguauguguccguggucucuagccauuacucccggcgcuuuacgccggaaauugccaagagacccaaaguucgggaccaggagggccgcaucaacuauuacuggacacugcucgagccuggggauaccauuaucuucgaagcuaauggaaaccugauugcccccugguaugcuuuugcccuuagcagaggcuucgggucuggaaucauuacauccaaugcgagcaugggcgagugugacgccaagugccagaccccucaaggcgcuaucaacucuagccugcccuuucagaaugugcacccggugaccaucggggaauguccuaaauacguccgguccacaaagcuccgcauggugacgggacugagaaacauucccucuauccagagccggggccuuuucggggccauugcuggauuuaucgagggcggguggaccggaaugauugauggcugguauggcuaccaucaccagaaugaacaaggguccggauacgccgccgaccagaaaagcacacagaacgcuaucgauggcaucaccaauaagguuaacucugugauugagaaaaugaauacacaguucaccgcggucgggaaggaguucaacaagcuggaacgcagaauggagaaucucaacaaaaagguggacgauggauuucuggacaucuggacguauaaugccgaacugcucguucugcuugagaacgaacggacacuggacuuccacgauuccaacgugaaaaaucucuacgagaaggucaaaaaccaacugaagaauaacgcuaaggagauuggcaaugggugcuuugaguucuaucauaaauguaacaaugaaugcauggaaagcgugaagaacggcaccuacgacuauccuaaauacucugaggaguccaaacuuaaucgcgagaaaaucgauggagucaagcuggaaagcaugggcguguaucagauucucgccaucuacuccaccguugccucuagccuggugcugcucgucucccugggggcuaucucuuuuuggaugugcagcaacggaucccuucaguguagaauuugcaucuga

SEQ ID NO: 184154 - RNA, 1701 nt, Artificial Sequence
  derived and/or modified sequence opt5 from hemagglutinin__InfluenzaA__ABG88333
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaagucuuccuuuuaucggaaucuccuguggcuuaccgagaaaaacggcagcuacccuaaucuguccaagucuuaugucaacaauaaggaaaaagaggugcucguucuguggggagugcaucaccccagcaacaucgaagaccagaagacaauuuaccgcaaagagaaugccuacgucuccguggugagcucucacuauaacagacgguucaccccugaaaucuccaagcgcccgaaagucagagggcaggagggccggauuaacuacuauuggacacugcucgagcccggggauaccaucauuuuugaagcgaauggaaaccugaucgccccuugguacgcuuucgcccuuagccgcggcuuugggucuggaauuaucacgagcaaugcuuccauggacgagugugaugccaagugccagacaccccaaggcgcgaucaacucuagccugccuuuccagaauguucaucccgugaccauuggcgaauguccgaaauaugugagauccacaaagcuccggauggucaccgggcugcgcaacaucccuagcauucagucuagaggacuuuuuggcgccaucgcuggguucauugagggaggcuggaccgggaugaucgacggaugguacggcuaucaccaucagaaugaacaaggcuccggguacgccgcugaucagaagucuacacagaacgccaucaauggaauuacgaacaaagugaauagcguuaucgagaagaugaacacccaguuuacagccgugggcaaagaguucaauaagcuggaaaaacggauggagaaccucaauaagaaggucgacgauggguuccuggacauuuggaccuacaacgcugaacugcucgugcugcuugagaacgaacgcacacuggacuuucacgauuccaauguuaaaaaccucuaugagaaggugaaaagccaacugaagaauaacgcgaaagagaucggaaauggcugcuucgaauuuuaccacaaguguaacaaugagugcauggaauccgucaagaacgggaccuaugacuaccccaaauauucugaggagagcaaacuuaauagagaaaagauugauggcgugaagcuggaguccaugggagucuaccagauccucgccaucuauucuacgguggcuagcucccugguucugcucgugagccugggcgccauuucuuucuggaugugcuccaacgggagccuucagugucggaucugcauuuga

SEQ ID NO: 184155 - RNA, 1701 nt, Artificial Sequence
  derived and/or modified sequence opt5 from hemagglutinin__InfluenzaA__ABG88344
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaagucuuccuuuuaucggaaucuccuguggcuuaccgagaaaaacggcagcuacccuaaucuguccaagucuuaugucaacaauaaggaaaaagaggugcucguucuguggggagugcaucaccccagcaacaucgaagaccagaagacaauuuaccgcaaagagaaugccuacgucuccguggugagcucucacuauaacagacgguucaccccugaaaucuccaagcgcccgaaagucagaaaccaggaggggcggauuaauuacuauuggacacugcucgagcccggcgauaccaucauuuuugaagcgaacgggaaucugaucgccccuugguacgcuuucgcccuuagccgcggauuuggcucugggauuaucacgagcaacgcuuccauggacgagugugaugccaagugccagacaccccaaggagcgaucaauucuagccugccuuuccagaacguucaucccgugaccauuggcgaauguccgaaauaugugagauccacaaagcuccggauggucaccggccugcgcaauaucccuagcauucagucuagagggcuuuuuggagccaucgcuggcuucauugaagggggauggaccggcaugaucgacgggugguacggauaucaccaucagaacgaacaaggcuccggcuacgccgcugaucaaaagagcacacagaaugccaucaacgggauuacgaauaaagugaacucuguuaucgagaagaugaauacccaguuuacagccgugggaaaagaguucaacaagcuggaaaaacggauggagaaucucaacaagaaggucgacgauggcuuccuggacauuuggaccuacaacgcugaacugcucgugcugcuugagaaugaacgcacacuggacuuucacgauuccaacguuaaaaaucucuaugagaaggugaaaagccagcugaagaacaaugcgaaagagaucgggaacggaugcuucgaauuuuaccacaaguguaauaacgagugcauggaauccgucaagaauggcaccuaugacuaccccaaauauucugaggagagcaaacuuaacagagagaagauugauggggugaagcuggaguccaugggcgucuaccagauccucgccaucuauucuacgguggcuagcucccugguucugcucgugagccugggagccauuucuuucuggaugugcuccaauggcagccuucagugucggaucugcauuuga

SEQ ID NO: 184156 - RNA, 1701 nt, Artificial Sequence
  derived and/or modified sequence opt5 from hemagglutinin__InfluenzaA__ABG88355
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuaugccugcaagcggggcucugucaauuccuuuuucagccgccucaacuggcugcacaaacuugaguacaaguaucccgcgcugaaugugaccaugccuaacaaugggaaauuugauaagcucuacauuuggggaguucaucacccgucuacagacuccgaucaaaccagccuguacgugagagccucuggcaaagucacgguguccacaaagcggagccagcagaccgugauccccgacauuggguaucgcccuugggucagaggacuguccucucggaucagcauuuacuggacaaucguuaagcccggcgacauucuccugaucaacuccaccgggaaccuuaucgcuccucgcggauauuucaaaauuagaaauggcgagagcucuaucaugcgguccgaugcccccauuggcaacuguagcucugaaugcaucaccccgaaugggagcauuccuaacgacaagcccuuucagaaugugaaccgcaucacauacggagcuuguccuagauaugugaaacaaaauacgcugaagcucgccaccggcaugcggaacguccccgagaaacagacacgcgggaucuucggagcgauugccggcuuuaucgaaaaugggugggagggaaugguggauggcugguacggcuucagacaccagaacuccgaggggaccggacaggcugccgaccugaagucuacacaagcugccauugaucagaucaauggcaaacuuaaccggcugguugaaaagaccaaugagaaguuucaucagauugaaaaagaguucagcgaaguggaggggagaauccaagaccucgagaaguaugucgaagauacgaaaaucgaccugugguccuacaacgccgagcugcucguggcucuggaaaaucagcacacaauugaucuuaccgacagcgagaugaacaagcuguucgaacgcacccggaaacagcucagagagaacgcggaggauaugggaaauggcugcuuuaagaucuaccauaagugugacaacgccugcauugggucuauccgcaauggcacauaugaccacgauguuuaccgggacgaagcucugaacaauagauuccagauuaaaggaguggagcuuaaguccggcuauaaagauuggauccuguggauuagcuuugccaucucuugcuuccuccugugugucgugcugcucggguuuaucaugugggccugccaaaagggaaacauucgcuguaauaucugcauuuga

SEQ ID NO: 184157 - RNA, 1701 nt, Artificial Sequence
  derived and/or modified sequence opt5 from hemagglutinin__InfluenzaA__ABG88366
augaagaccaucauugcccugagcuacuuccucugccugguguuugcucagaaacuucccggcaacgacaauuccacagccacgcugugucucgggcaccaugcggucccuaacggaacccugguuaagacaaucaccaaugaucaaauugaggugacaaacgcuaccgaacuugugcaaaauucuccgacaggcagaaucugcgacagcccccaccggauucuggaugggaaaaacuguacccucaucgacgcccugcugggagauccucauugcgacggcuuccagaauaaggagugggaucucuuugucgaacgcuccaaagccuauucuaacuguuaccccuaugacgugccugauuacgcuagccugagaucccuuguugccucuagcgggacgcuggaguucaccaaugaaaacuuuaauuggacaggaguggcucaggacggcaaguccuaugccugcaagcggggcagcgucaacucuuucuuuucccgccucaauuggcugcacaaacuugaguacaaguaucccgcgcugaacgugaccaugccuaauaacgggaaauucgauaagcucuacaucuggggaguucaucacccgagcacagacucugaucagaccucccuguacgugagagccagcggcaaagucacggugucuacaaagcggucccagcagaccgugauucccgacaucggguaucgcccuugggucagaggacugagcucccggauuucuaucuacuggacaauuguuaagcccggcgacauccuccugauuaacagcaccgggaaucuuaucgcuccucgcggauauuuuaaaaucagaaacggcaaguccagcauuaugcggucugaugcccccaucggcaauuguuccagcgagugcauuaccccgaacgggucuaucccuaaugacaaacccuuccagaacgugaaucgcauuacauacggagcuuguccuagauaugugaagcaaaacacgcugaaacucgccaccggcaugcggaauguccccgaaaagcagacacgcgggaucuuuggagcgaucgccggcuucauugagaacgggugggaaggaaugguggauggcugguacggcuuuagacaccagaauagcgaggggaccggacaggcugccgaccugaaauccacacaagcugccaucgaucagauuaacggcaaacuuaaucggcugguugagaagaccaacgaaaaguuccaucagaucgagaaggaguucucugaaguggaagggcgcauucaagaccucgagaaauaugucgaggauacgaagaucgaccuguggagcuacaaugccgaacugcucguggcucuggagaaccagcacacaaucgaucuuaccgacuccgaaaugaacaaacuguuugagagaacccggaagcagcucagagaaaaugcggaggauaugggaaacggcugcuucaagauuuaccauaaaugugacaaugccugcaucgggagcauucgcaacggcacauaugaccacgauguuuaccgggacgaggcucugaauaacagauuucagaucaagggaguggaacuuaaaucuggcuauaaggauuggauucuguggaucuccuucgccauuagcugcuuucuccugugugucgugcugcucggguucaucaugugggccugccaaaaaggaaauauccgcuguaacauuugcaucuga

SEQ ID NO: 184158 - RNA, 1701 nt, Artificial Sequence; identical to SEQ ID NO: 184008
  derived and/or modified sequence opt5 from hemagglutinin__InfluenzaA__ABG88377

SEQ ID NO: 184159 - RNA, 1701 nt, Artificial Sequence; identical to SEQ ID NO: 184008
  derived and/or modified sequence opt5 from hemagglutinin__InfluenzaA__ABG88388

SEQ ID NO: 184160 - RNA, 1701 nt, Artificial Sequence
  derived and/or modified sequence opt5 from hemagglutinin__InfluenzaA__ABG88399
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaucuuucaacuggacaggaguggcucaggacggcaaguccuaugccugcaaacggggcagcgucaauucuuucuucucccgccucaacuggcugcacaaacuugaguacaaguauccugcgcugaaugugaccaugcccaacaaugauaaguuugacaaacucuacauuuggggaguucaucacccuagcacagauucugaccaaaccucccuguacgugcaggccagcgggagagucacgguguccacaaagcggucucagcagaccgugaucccgaacauuggcagccgccccugggucagagggaucuccagccggauuucuaucuauuggacaauuguuaagccuggagacauccugcucaucaauuccaccggcaaccugauugcuccccgcggguacuucaaaaucagaaacggaaagagcucuauuaugcggagcgaugccccuaucggcaauuguaacuccgagugcauuacccccaauggcucuaucccgaacgacaaaccuuuucaaaaugugaaccgcaucacauauggggcuugucccagauacgugaagcagaauacgcuuaaacuggccaccggaaugcggaacgucccugaaaagcagacacgcggcauuuucggggcgaucgccggauuuauugagaauggcugggaagggaugguggauggaugguauggcuucagacaccagaacagcgagggcaccgggcaagcugccgaccucaaauccacacaggcugccaucgaucagauuaauggaaagcugaaccggcuuaucgagaagaccaaugaaaaauuucaucaaaucgagaaggaauuuagcgagguugaaggccgcauucaggaccuggagaaauacguggaggauacgaagaucgaccucuggucuuauaacgccgaacugcuggucgcucucgagaaucagcacacaauugaucugaccgacuccgaaaugaacaaacuuuucgagagaacccggaagcagcugagagaaaacgcggaggauauggggaauggaugcuuuaagaucuaccauaaaugugacaacgccugcauuggcagcauccgcaaugggacauacgaccacgauguguaucgggacgaggcucucaacaauagauuccaaauuaagggcguugaacugaaaucuggauacaaggauuggauccuuuggaucuccuuugccauuagcugcuuccugcucugugugguccugcugggcuuuaucaugugggccugccagaaagggaacauucgcuguaauaucugcauuuga

SEQ ID NO: 184161 - RNA, 1701 nt, Artificial Sequence; identical to SEQ ID NO: 184048
  derived and/or modified sequence opt5 from hemagglutinin__InfluenzaA__ABG88410

SEQ ID NO: 184162 - RNA, 1701 nt, Artificial Sequence; identical to SEQ ID NO: 184048
  derived and/or modified sequence opt5 from hemagglutinin__InfluenzaA__ABG88421

SEQ ID NO: 184163 - RNA, 1701 nt, Artificial Sequence
  derived and/or modified sequence opt5 from hemagglutinin__InfluenzaA__ABG88432
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagaugcggaauggcaaaucuuccaucaugcgcagcgaugccccuauuggcaacuguucuagcgagugcaucacccccaauggguccauuccgaacgacaagccuuuccagaaugugaacagaaucaccuauggagcuuguccccgguacgugaaacaaaauacacugaagcucgccacgggcaugcgcaacgucccugaaaaacagaccagagggaucuuuggagcgauugccggcuucaucgagaaugggugggaaggaaugguggauggcugguauggcuuucggcaccagaacucugaggggacaggacaggcugccgaccuuaagagcacccaagcugccauugaucagaucaauggcaaacugaacagacugauugagaagacaaaugaaaaguuccaucagaucgagaaagaguucuccgaaguugaagggcgcauccaagaccucgagaaguacguggaggauaccaaaauugaccuguggagcuauaacgccggacugcucgucgcucuggaaaaucagcacacgaucgaucuuacagacucugagaugaacaagcuguuugaacggaccagaaaacagcuccgcgagaacgcggaagauaugggcaaugggugcuucaagauuuaccauaagugugacaacgccugcaucggcuccauucggaauggaaccuacgaccacgauguguauagagacgaggcucugaacaaucgcuuucagaucaaaggcguugagcuuaagagcggguacaaagauuggauucuguggaucucuuucgccaucuccugcuuucuccugugugugguccugcucggauucauuaugugggccugccaaaagggcaacauccgguguaauauuugcaucuga

SEQ ID NO: 184164 - RNA, 1701 nt, Artificial Sequence; identical to SEQ ID NO: 184048
  derived and/or modified sequence opt5 from hemagglutinin__InfluenzaA__ABG88443

SEQ ID NO: 184165 - RNA, 1701 nt, Artificial Sequence
  derived and/or modified sequence opt5 from hemagglutinin__InfluenzaA__ABG88454
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgcgaacagcuuuuucucucgccucaauuggcugcacaaacuugaguacaaguauccugcccugaacgucacaaugcccaauaacgggaaauuugacaagcucuacaucuggggagugcaucacccuuccaccgauagcgaccaaacaucucuguacguuagagcuuccggcggggugaccgucagcacgaaacggucccagcagacagugauuccgaauaucggaucucgccccugggugagaggccugagcucccggauuagcaucuauuggaccauugucaagccuggggacauccuccugaucaacucuacaggaaaccuuauugcccccagaggcuacuucaagaucagauccggcaaaagcucuauuaugcggagcgaugcuuccaucgggaauuguucuagcgagugcauuaccccuaacggauccauccccaaugacaagccguuucagaacguuaaucgcaucaccuauggcgccuguccuagauacgugaaacaaaacacacugaagcucgcgacggggaugcggaaugugcccgaaaaacagacccgcggaauuuucggcgccaucgcuggguuuauugagaacggaugggaaggcauggucgauggcugguauggguucagacaccagaauagcgagggaacaggccaggccgcugaccugaagucuacccaagccgccaucgaucagauuaacgggaaacuuaaucggcugaucggaaagacaaacgacaaguuucaucagaucgagaaagaguucuccgaaguggaaggccgcauucaagaucucgagaaguacguugaagacaccaaaaucgaucuguggagcuauaaugcugagcugcucguggcgcuggagaaccagcacacgauugaccuuacagauucugaaaugaauaagcuguucgagcgcacccggaaacagcucagagaaaacgccgaggacauggggaacggcugcuuuaagaucuaccauaagugugacaaugcuugcauuggauccauccgcaacggcaccuacgaucacgacgucuaucgggaugaagcccugaauaacagauuccagauuaaagggguggagcuuaagagcggauacaaagacuggauccuguggaucuccuuugccauuucuugcuuccuccuguguguugugcugcucggcuuuaucaugugggcuugccaaaaggggaauauucgcuguaacaucugcauuuga

SEQ ID NO: 184166 - RNA, 1701 nt, Artificial Sequence
  derived and/or modified sequence opt5 from hemagglutinin__InfluenzaA__ABG88465
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacauuccugaaaaacagaccagagggaucuuuggagcgauugccggcuucaucgagaaugggugggaaggaauggucgauggcugguauggcuuucggcaccagaacucugaggggacaggacaggcugccgaccuuaagagcacccaagcugccauugaucagaucaauggcaaacugaacagacugaucgagaagacaaaugaaaaguuccaucagauugagaaagaguucuccgaaguggaagggcgcauccaagaccucgagaaguacguugaggauaccaaaauugaccuguggagcuauaacgccggacugcucguggcucuggaaaaucagcacacgaucgaucuuacagacucugagaugaacaagcuguuugaacggaccagaaaacagcuccgcgagaacgcggaagauaugggcaaugggugcuucaagauuuaccauaagugugacaacgccugcaucggcuccauucggaauggaaccuacgaccacgaugucuauagagacgaggcucugaacaaucgcuuucagaucaaaggcguggagcuuaagagcggguacaaagauuggauccuguggauuucuuucgccaucuccugcuuucuccuguguguugugcugcucggauucauuaugugggccugccaaaagggcaacauccgguguaauauuugcaucuga

SEQ ID NO: 184167 - RNA, 1701 nt, Artificial Sequence; identical to SEQ ID NO: 184048
  derived and/or modified sequence opt5 from hemagglutinin__InfluenzaA__ABG88476

SEQ ID NO: 184168 - RNA, 1701 nt, Artificial Sequence; identical to SEQ ID NO: 184048
  derived and/or modified sequence opt5 from hemagglutinin__InfluenzaA__ABG88487

SEQ ID NO: 184169 - RNA, 1701 nt, Artificial Sequence; identical to SEQ ID NO: 184048
  derived and/or modified sequence opt5 from hemagglutinin__InfluenzaA__ABG88498

SEQ ID NO: 184170 - RNA, 1701 nt, Artificial Sequence; identical to SEQ ID NO: 184048
  derived and/or modified sequence opt5 from hemagglutinin__InfluenzaA__ABG88509

SEQ ID NO: 184171 - RNA, 1701 nt, Artificial Sequence
  derived and/or modified sequence opt5 from hemagglutinin__InfluenzaA__ABG88520
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacaaggagugggaucuguucgucgaacgcuccaaagccuauucuaauuguuacccuuaugacgugcccgauuacgcuagccucagaucccugguugccagcucugggacgcuugaguuuauuaacgaagacuucaauuggaccggaguggcucaggauggcaaguccuaugccugcaagcggggcagcgucaacucuuucuucucccgccugaauuggcuccacaaacuggaguacaaguauccugcgcuuaacgugacaaugcccaauaacgggaaauuugacaagcuguacaucuggggaguucaucacccuagcaccgauucugaccaaacaucccucuacgugagagccagcggccgggucaccguguccacgaaacgcucucagcagacagugauuccgaauaucggguucagacccuggguccggggacugagcucccgcauuagcaucuauuggaccauuguuaagccuggcgacauccugcucaucaacucuacagggaaccugauugcucccagaggauacuuuaagauccggaauggcaaauccagcauuaugcgcucugaugccccuaucggcaacuguagcuccgagugcauuacccccaaugggucuaucccgaacgacaagccuuuccagaaugugaacagaaucaccuauggagcuuguccccgguacgugaaacaaaauacacuuaagcuggccacgggcaugcgcaacgucccugaaaaacagaccagagggauuuuuggagcgaucgccggcuucauugagaaugggugggaaggaaugguggauggcugguauggcuuucggcaccagaacagcgaggggacaggacaggcugccgaccucaaguccacccaagcugccaucgaucagauuaauggcaaacugaacagacuuaucgagaagacaaaugaaaaguuccaucagaucgagaaagaauuuagcgagguugaagggcgcauucaagaccuggagaaguacguggaggauaccaaaaucgaccucuggucuuauaacgccggacugcuggucgcucucgaaaaucagcacacgauugaucugacagacuccgagaugaacaaacuuuuugaacggaccagaaagcagcugcgcgagaacgcggaagauaugggcaaugggugcuucaagaucuaccauaagugugacaacgccugcauuggcagcauccggaauggaaccuacgaccacgauguguauagagacgaggcucucaacaaucgcuuucagauuaaaggcguugagcugaagucuggguacaaagauuggauccuuuggaucuccuucgccauuagcugcuuucugcucugugugguccugcugggauucacaaugugggccugccaaaagggcaacauccgguguaauauuugcaucuga

SEQ ID NO: 184172 - RNA, 1701 nt, Artificial Sequence
  derived and/or modified sequence opt5 from hemagglutinin__InfluenzaA__ABG88531
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgugcaaacaucucuguacgucagagccuccggccgggugaccgugagcacgaaacgcucccagcagacagucauuccgaauaucggguucagacccuggguucggggacugucuagccgcauuuccaucuauuggaccauugugaagccuggcgacauccuccugaucaacagcacagggaaccuuauugcucccagaggauacuuuaagauccggaauggcaaaucuuccauuaugcgcagcgacgccccuaucggcaacuguucuagcgagugcauuacccccaauggguccaucccgaacgauaagccuuuccagaaugugaacagaaucaccuauggagcuuguccccgguacgucaaacaaaauacacugaagcucgccacgggcaugcgcaacgugccugaaaaacagaccagagggauuuuuggagcgaucgccggcuucauugagaaugggugggaaggaaugguugacggcugguauggcuuucggcaccagaacucugaggggacaggacaggcugccgaucuuaagagcacccaagcugccaucgaccagauuaauggcaaacugaacagacugaucgagaagacaaaugaaaaguuccaucagaucgagaaagaguucuccgaaguggaagggcgcauucaagaucucgagaaguacgucgaggacaccaaaaucgaucuguggagcuauaacgccggacugcucguggcucuggaaaaucagcacacgauugaccuuacagauucugagaugaacaagcuguuugaacggaccagaaaacagcuccgcgagaacgcggaagacaugggcaaugggugcuucaagaucuaccauaagugugauaacgccugcauuggcuccauccggaauggaaccuacgaccacgacguuuauagagaugaggcucugaacaaucgcuuucagauuaaaggcguggagcuuaagagcggguacaaagacuggauccuguggaucucuuucgccauuuccugcuuucuccugugugucgugcugcucggauucaucaugugggccugccaaaagggcaacauucgguguaauaucugcauuuga

SEQ ID NO: 184173 - RNA, 1698 nt, Artificial Sequence; identical to SEQ ID NO: 184059
  derived and/or modified sequence opt5 from hemagglutinin__InfluenzaA__ABG88553

SEQ ID NO: 184174 - RNA, 1701 nt, Artificial Sequence; identical to SEQ ID NO: 183734
  derived and/or modified sequence opt5 from hemagglutinin__InfluenzaA__ABG88564

SEQ ID NO: 184175 - RNA, 1701 nt, Artificial Sequence; identical to SEQ ID NO: 183764
  derived and/or modified sequence opt5 from hemagglutinin__InfluenzaA__ABG88575

SEQ ID NO: 184176 - RNA, 1701 nt, Artificial Sequence; identical to SEQ ID NO: 183674
  derived and/or modified sequence opt5 from hemagglutinin__InfluenzaA__ABG88586

SEQ ID NO: 184177 - RNA, 1701 nt, Artificial Sequence
  derived and/or modified sequence opt5 from hemagglutinin__InfluenzaA__ABG88597
augaagaccaucauugcccugagcuacauccucugccugguguucgcucagaaacuucccgccaacgacaauuccacagcgacgcugugucucggccaccaugcugucccuaacgggacccugguuaagacaauuaccaaugauaacaucgaggugacaaaugccaccgaacuugugcaaucuagcuccacaggaagaauuugcgacucuccgcaccagauccuggauggcgagaacuguacccucaucgacgcccugcugggggauccccauugcgacggauuucagaauaaagaaugggaucucuucgucgagcggagcacggcuuauuccaacuguuacccuuaugacgugcccgauuacgccucucugcgcagccuuguugcuuccagcggcacccuggaauuuaauaacgagucuuucaauuggacagggguggaccagaacggaaccuccagcgccugcaagagacggucuaauaaauccuuuuucagccgccucaacuggcugcaccaacuuaaguauaaguacccugcgcugaaugucacaaugcccaacaacgagaaauuugauaagcucuauauuuggggcgugcaucacccuucuaccgacuccgaucagaucagccuguacgcccaggcuuccggcagaguuacggugucuacaaaacggagccagcaaaccgucauuccgaauaucgggucccgccccugggugagaggagugagcucucggauuuccaucuacuggacaauugucaagccuggcgacauccugcucaucaacagcaccgggaaucugauugcccccagaggauauuucaaaaucagaucuggcaagagcuccauuaugcggucuaacgcuccuaucgggaaguguaauagcgaaugcauuacccccaacggauccaucccgaaugacaaaccuuuucagaacguuaaucgcaucacauacggcgccugucccagauaugugaagcagaacacgcuuaaacuggcgaccggcaugcggaaugugccugagaagcagacacgcgggauuuucggagccaucgcuggcuuuauugaaaacgggugggagggaauggucgauggcugguacggguucagacaccaaaauagcgagggaaccggccaggccgcugaccucaaaucuacacaggccgccaucaaccaaauuaauggcaagcugaaccggcuuaucgagaaaaccaacgaaaaguuucaucagaucgaaaaggaguucuccgaaguggaggggcgcauucaggaucuggagaaauauguugaagacacgaagaucgaucucuggagcuacaaugcugagcugcugguggcgcucgaaaaccagcacacaauugaccugaccgauucugagaugaauaaacuuuucgaacgcacccggaagcaacugagagagaacgccgaggacaugggaaauggcugcuuuaaaaucuaucauaagugugauaacgcuugcauuggguccauccgcaauggaacauacgaccacgaugucuaccgggacgaagcccucaacaauagauuccagauuaagggcguggagcugaaaagcggguauaaggacuggauccuuuggaucuccuuugccauuucuugcuuccugcucuguguugugcugcugggcuuuaucaugugggcuugccagaaaggaaacauucgcuguaauaucugcauuuga

SEQ ID NO: 184178 - RNA, 1701 nt, Artificial Sequence
  derived and/or modified sequence opt5 from hemagglutinin__InfluenzaA__ABG88608
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagccgcgccuauuccaauuguuacccuuaugacgugcccgauuacguuucucugagaagccuuguggcuuccagcgggacgcuggaauuuaacaaugagucuuucaacuggaccggagucgcccaaaauggcacauccagcgcuugcaagcggcgcucugacaaauccuuuuucagcagacucaacuggcugcaccagcuuaaguauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugcgcggggucuccagccggauuucuaucuacuggaccauuguuaagccuggagacauccugcucaucaacuccacaggcaaucugauugcucccagaggguauuucaaaauccggagcggaaagucuagcauuaugcgcuccgacgccccuaucggcaaguguaacucugaaugcauuacccccaauggcagcaucccgaacgauaaaccuuuucagaaugugaacagaaucaccuacgggcccuguccucgguaugugaagcagaauacacuuaaacuggcuacgggaaugcgcaacguccccgagaagcaaaccagaggcauuuucggggccaucgcgggauuuauugaaaauggcugggaggggaugauggacggaugguacggcuuccggcaccagaacuccgagggcacagggcaggccgcugaucucaaaagcacccaagccgcuaucaaucagauuaacggaaagcugaauagacuuaucgagaaaacaaacgaaaaguuucaucagaucgaaaaggaguucucugaaguggagggccgcauucaggaccuggagaaauauguugaagauaccaagaucgaccucugguccuacaaugccgagcugcugguggcccucgaaaaccaacacacgauugaucugacagacagcgagaugaacaaacuuuucgaacggaccaagaaacagcugagagagaaugcugaggauauggggaacggaugcuuuaagaucuaucauaagugugacaaugcgugcauuggcucuauccgcaacgggaccuacgaucacgacgucuaccgggacgaagcccucaauacaagauuccagauuaaaggcguggagcugaaguccggauauaaagauuggauccuuuggaucagcuuugcuauuuccugcuuccugcucuguaucguucugcugggcuuuauuaugugggccugccagaaggggaacauccgcuguaauauuugcaucuga

SEQ ID NO: 184179 - RNA, 1701 nt, Artificial Sequence; identical to SEQ ID NO: 183586
  derived and/or modified sequence opt5 from hemagglutinin__InfluenzaA__ABG88619

SEQ ID NO: 184180 - RNA, 1701 nt, Artificial Sequence
  derived and/or modified sequence opt5 from hemagglutinin__InfluenzaA__ABG88630
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagguccuggauggggagaauuguacccucaucgacgcccugcugggagauccccauugcgacggcuuucagaacaaagaaugggaucucuucguggagcggagcaaggccuauuccaauuguuacccuuaugacguucccgauuacgugucucugcgcagccuugucgcuuccagcgggacgcuggaauuuaacaaugagucuuucaacuggaccggaguggcccaaaauggcacauccagcgcuugcaaaagacggucugacaaguccuuuuucagccgccucaacuggcugcaccagcuuaaguauaaauacccugcccugaauguuaccaugcccaacaaugagaaguuugauaaacucuauaucuggggcgugcaucacccugggacagacucugaucagauuucccuguacgcgcaggccagcggaagagucaccguguccacgaagcggucucaacagacagugaucccgaacauuggcagccgccccugggucagagggguuuccagccggaucucuauuuacuggaccaucgugaaaccuggagacauucugcucaucaacuccacaggcaaucugaucgcuccccgcggguauuucaagauuagaagcggaaagucuagcaucaugcgguccgacgccccuauuggcaaauguaacucugaaugcaucacccccaauggcagcauuccgaacgauaagccuuuucagaaugugaaccgcaucaccuacggggcuugucccagauaugucaaacagaagacacuuaaacuggccacgggaaugcggaaugugccugagaagcaaacccgcggcaucuucggggcgauugccggauuuaucgaaaacggcugggaggggaugauggacggaugguacggcuucagacaccaaaauuccgagggcacagggcaggcugccgaucucaaaagcacccaggcugccauuaaccagaucaauggaaagcugaaccggcuuauugaaaagacaaaugagaaauuucaucagaucgaaaaggaguucucugaaguugagggcagaauccaggaccuggagaaauauguggaagauaccaagauugaccucugguccuacaacgccgagcugcuggucgcucucgaaaaucaacacacgaucgaucugacagacagcgagaugaacaaacuuuucgaacgcaccaagaagcagcugcgggagaacgcggaggauauggggaauggaugcuuuaaaauuuaucauaagugugacaacgccugcaucggcucuauuagaaaugggaccuacgaucacgacguguaccgcgacgaagcucucaacaaucgguuccagaucaaaggcguugagcugaaguccggauauaaagauuggauucuuuggaucagcuuugccaucuccugcuuccugcucuguauugugcugcugggcuuuaucaugugggccugccagaaggggaacauuagauguaauaucugcauuuga

SEQ ID NO: 184181 - RNA, 1701 nt, Artificial Sequence
  derived and/or modified sequence opt5 from hemagglutinin__InfluenzaA__ABG88641
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggauccggccccugggugcgcggggucagcucuagaauuuccaucuacuggaccauuguuaaaccuggagacauccugcucaucaacagcacaggcaaucugauugcuccccggggguauuucaagauccgcucuggaaagagcuccauuaugagaucugacgccccuaucggcaaauguaacagcgaaugcauuacccccaauggcuccaucccgaacgggaagccuuuucagaaugugaaccggaucaccuacggagcuuguccccgcuaugugaaacagaauacacuuaagcuggccacgggcaugagaaacgucccugagaaacaaacccgggggauuuucggagcgaucgccggcuuuauugaaaaugggugggagggaaugauggauggcugguacggcuuccgccaccagaacagcgaggggacaggacaggcugccgaccucaagucuacccaagcugccaucaaucagauuaacggcaaacugaauagacuuaucgaaaagacaaacgagaaguuucaucagaucgaaaaagaguucuccgaaguggaggggcggauucaggaucuggagaaguauguugaagacaccaaaaucgaucucuggagcuacaaugccgagcugcugguggcucucgaaaaccaacacacgauugaccugacagauucugagaugaacaaacuuuucgaaagaaccaagaagcagcugcgcgagaaugcggaggacaugggaaacggcugcuuuaagaucuaucauaaaugugauaaugccugcauuggguccauccggaacggcaccuacgaccacgaugucuacagagacgaagcucucaauaaccgcuuccagauuaagggaguggagcugaaaagcggcuauaaggacuggauccuuuggaucuccuuugccacaucuugcuuccugcucuguauuguucugcugggguuuaucaugugggccugccagaaaggaaauauucgguguaacaucugcauuuga

SEQ ID NO: 184182 - RNA, 1701 nt, Artificial Sequence; identical to SEQ ID NO: 183540
  derived and/or modified sequence opt5 from hemagglutinin__InfluenzaA__ABG88652

SEQ ID NO: 184183 - RNA, 1701 nt, Artificial Sequence; identical to SEQ ID NO: 183540
  derived and/or modified sequence opt5 from hemagglutinin__InfluenzaA__ABG88663

SEQ ID NO: 184184 - RNA, 1701 nt, Artificial Sequence; identical to SEQ ID NO: 183540
  derived and/or modified sequence opt5 from hemagglutinin__InfluenzaA__ABG88674

SEQ ID NO: 184185 - RNA, 1701 nt, Artificial Sequence; identical to SEQ ID NO: 183540
  derived and/or modified sequence opt5 from hemagglutinin__InfluenzaA__ABG88685

SEQ ID NO: 184186 - RNA, 1701 nt, Artificial Sequence; identical to SEQ ID NO: 183540
  derived and/or modified sequence opt5 from hemagglutinin__InfluenzaA__ABG88696

SEQ ID NO: 184187 - RNA, 1701 nt, Artificial Sequence; identical to SEQ ID NO: 183306
  derived and/or modified sequence opt5 from hemagglutinin__InfluenzaA__ABG88707

SEQ ID NO: 184188 - RNA, 1701 nt, Artificial Sequence; identical to SEQ ID NO: 183306
  derived and/or modified sequence opt5 from hemagglutinin__InfluenzaA__ABG88718

SEQ ID NO: 184189 - RNA, 1701 nt, Artificial Sequence
  derived and/or modified sequence opt5 from hemagglutinin__InfluenzaA__ABG88729
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaacuugaguacaaguauccugcgcugaacgugacaaugcccaauuccggaaaguuugacaaacucuacaucuggggcguucaucacccuagcaccgauucugaccaaacaucccuguacgugagagccagcgggcgggucaccguguccacgaagcgcucucagcagacagugaccccgaacauuggaagcagacccuggguccggggccuguccagccgcaucucuauuuauuggacaaucguuaaaccuggggacauucuccugaucaauuccaccggaaaccuuaucgcucccagaggcuacuucaagauucggaacggcaagagcucuaucaugcgcagcgaugccccuauugggaauuguuccucugagugcaucacccccaacggaagcauuccgaaugacaaaccuuuucagaacgugaauagaaucacauauggcgcuuguccccgguacgugaagcaaaacacgcugaaacucgccaccgggaugcgcaaugucccugaaaagcagacaagaggaaucuucggcgcgauugccggguuuaucgagaacggaugggaaggcaugguggauggcugguauggguuccggcaccaaaauuccgagggaaccggccaggcugccgaccugaaaagcacacaggcugccauugaucagaucaacgggaaacuuaauagacugauugagaagaccaacgaaaaguuucaucagaucgagaaggaguucucugaaguugaaggacgcauccaagaccucgagaaauacguggaggauacgaagauugaccugugguccuauaaugccgaacugcucgucgcucuggagaaccagcacacaaucgaucuuaccgacagcgaaaugaauaaacuguucgagaagacccggaaacagcucagagaaaacgcggaggauaugggcaacgggugcuuuaagauuuaccauaagugugacaaugccugcaucggcucuauucgcaacggaacauacgaccacgauguguaucgggacgaggcucugaauaacagauuccagaucaaaggcguugaacuuaaguccggguacaaagauuggauucuguggaucagcuuugccaucuccugcuuccuccugugugugguccugcucggauuuauuaugugggccugccaaaagggcaauauccgcuguaacauuugcaucuga

SEQ ID NO: 184190 - RNA, 1701 nt, Artificial Sequence
  derived and/or modified sequence opt5 from hemagglutinin__InfluenzaA__ABG88740
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacauuaaacaaaauacacugaagcucgccacgggcaugcgcaacgugccugaaaaacagaccagagggaucuucggagcgauugccggcuuuaucgagaaugggugggaaggaauggucgauggcugguauggcuuccggcaccagaacagcgaggggacaggacaggcugccgaccugaaguccacccaagcugccauugaucagaucaauggcaaacuuaacagacugaucgagaagacaaaugaaaaguuucaucagauugagaaagaguucagcgaaguggaagggcgcauccaagaccucgagaaguacguugaggauaccaaaauugaccuguggucuuauaacgccgaacugcucguggcucuggagaaucagcacacgaucgaucuuacagacuccgaaaugaacaagcuguucgagcggaccagaaaacagcuccgcgaaaacgcggaggauaugggaaauggcugcuuuaagauuuaccauaagugugacaacgccugcaucgggagcauucggaauggcaccuacgaccacgaugucuauagagacgaggcucugaacaaucgcuuccagaucaaaggaguggaacuuaagucuggcuacaaagauuggauccuguggauuuccuuugccaucagcugcuuccuccuguguguugugcugcucggguuuauuaugugggccugccaaaagggaaacauccgguguaauauuugcaucuga

SEQ ID NO: 184191 - RNA, 1701 nt, Artificial Sequence; identical to SEQ ID NO: 184077
  derived and/or modified sequence opt5 from hemagglutinin__InfluenzaA__ABG88751

SEQ ID NO: 184192 - RNA, 1701 nt, Artificial Sequence
  derived and/or modified sequence opt5 from hemagglutinin__InfluenzaA__ABG88762
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcagaauuugcgacucuccgcaccggauccuggaugggaaaaauuguacgcucaucgacgcucugcugggagauccccauugcgacggcuuucagaacaaggagugggaucucuucgucgaacgcagcaaagccuauuccaauuguuacccuuaugacgugcccgauuacgccucucugagaagccuuguugcuuccagcgggacccuggaguuuauuaacgaagacuucaauuggacaggaguggcccaggauggcggcucuuaugcuugcaagcggggguccgucaacagcuuuuucucucgccucaauuggcugcacaaacuugaguacaaguauccugcccugaacgugaccaugcccaauaacggaaaguuugacaaacucuacaucuggggcguucaucacccuuccacagauagcgaccaaaccucucuguacgugagagcguccgggcgggucacggugagcacaaagcgcucccagcagaccgugauuccgaauaucggaucuagacccuggguccggggccugagcucccgcauuagcaucuauuggacaauuguuaaaccuggggacauccuccugaucaacucuaccggaaaccuuauugcccccagaggcuacuucaagauccggaauggcaaguccagcauuaugcgcucugaugcuagcaucgggaacuguuccucugagugcauuaccccuaauggaagcauccccaacgacaaaccguuucagaaugugaacagaaucacauauggcgccuguccucgguacgugaagcaaaauacgcugaaacucgcuaccgggaugcgcaacguccccgaaaagcagacaagaggaauuuucggcgccaucgcgggguuuauugagaauggaugggaaggcaugguggauggcugguauggguuccggcaccagaacuccgagggaaccggccaggccgcugaccugaaaagcacacaagccgcuaucgaucagauuaaugggaaacuuaacagacugaucgagaagaccaaugaaaaguuucaucagaucgagaaggaaguuucugagguggaaggacgcauucaagaccucgagaaauacgucgaggauacgaagaucgaccugugguccuauaacgccgaacugcucguggcccuggagaaucagcacacaauugaucuuaccgacagcgaaaugaacaaacuguucgagcggaccagaaagcagcuccgcgaaaacgcugaggauaugggcaaugggugcuucaaaaucuaccauaagugugacaacgcgugcauuggcucuauccggaauggaacauacgaccacgauguuuauagagacgaggcccugaacaaucgcuuucagauuaaguccguggaacuuaaaagcggcuacaaggauuggauccuguggaucuccuucgcuauuucuugcuuucuccugugugucgugcugcucggguucaucaugugggccugccaaaaaggaaacauucgguguaauaucugcauuuga

SEQ ID NO: 184193 - RNA, 1701 nt, Artificial Sequence
  derived and/or modified sequence opt5 from hemagglutinin__InfluenzaA__ABG88773
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccgccggcagaauuugcgacucuccgcaccggauccuggaugggaaaaauuguacacucaucgacgcccugcugggagauccccauugcgacggcuuucagaacaaggagugggaucucuucgucgaacgcagcaaggcuuauuccaauuguuacccuuaugacgugcccgauuacgccucucugagaagccuuguugcuuccagcgggacccuggaguuuauuaacgaagacuucaauuggacgggaguggcccaggauggcaaaucuuaugcgugcaagcggggcuccgucaacagcuuuuucucucgccucaauuggcugcacaaacuugaguacaaguauccugcccugaacgugaccaugcccaauaacgggaaauuugacaagcucuacaucuggggaguucaucacccuuccacagauagcgaccaaaccucucuguacgugagagcuuccggccgggucacagugagcaccaaacgcucccagcagacggugauuccgaauaucgggucuagacccuggguccggggacugagcucccgcauuagcaucuauuggacaauuguuaagccuggcgacauccuccugaucaacucuaccgggaaccuuauugcccccagaggauacuucaagauccggaauggcaaauccagcauuaugcgcucugaugcuccuaucggcaacuguagcuccgagugcauuacacccaaugggucuaucccgaacgacaagccuuuucagaaugugaacagaaucaccuauggagccuguccccgguacgugaaacaaaauacccugaagcucgcgacaggcaugcgcaacgucccugaaaaacagacgagagggauuuucggagccaucgcuggcuuuauugagaaugggugggaaggaaugguggauggcugguauggcuuccggcaccagaacagcgaggggaccggacaggccgcugaccugaaguccacacaagccgccaccgaucagaucaauggcaaacuuaacagacugauugagaagacaaaugaaaaguuucaucagaucgagaaagaguucagcgaaguugaagggcgcauccaagaccucgagaaguacguggaggauaccaaaauugaccuguggucuuauaacgcugaacugcucgucgcgcuggagaaucagcacacgaucgaucuuacagacuccgaaaugaacaagcuguucgagcggaccagaaaacagcuccgcgaaaacgccgaggauaugggaaauggcugcuuuaagauuuaccauaagugugacaacgcuugcaucgggagcauucggaauggcaccuacgaccacgauguguauagagacgaggcccugaacaaucgcuuccagaucaaaggaguugaacuuaagucuggcuacaaagauuggauucuguggaucuccuuugccaucagcugcuuccuccugugugugguccugcucggguuuauuaugugggcuugccaaaagggaaacauccgguguaauauuugcaucuga

SEQ ID NO: 184194 - RNA, 1701 nt, Artificial Sequence
  derived and/or modified sequence opt5 from hemagglutinin__InfluenzaA__ABG88784
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagcugccaucgaucagauuaauggcaaacuuaacagacugaucaagaagacaaaugagaaauuucaucagaucgaaaaggaguucagcgaaguugaggggcgcauucaagaccucgaaaaauacguggaggauaccaagaucgaccuguggucuuauaacgccgagcugcucgucgcucuggaaaaucagcacacgauugaucuuacagacuccgagaugaacaaacuguucgaacggaccagaaagcagcuccgcgagaacgcggaagauaugggaaauggcugcuuuaagaucuaccauaaaugugacaacgccugcauugggagcauccggaauggcaccuacgaccacgauguguauagagacgaggcucugaacaaucgcuuccagauuaagggaguugagcuuaaaucuggcuacaaggauuggauccuguggaucuccuuugccauuagcugcuuccuccugugugugguccugcucggguuuaucaugugggccugccaaaaaggaaacauucgguguaauaucugcauuuga

SEQ ID NO: 184195 - RNA, 1701 nt, Artificial Sequence
  derived and/or modified sequence opt5 from hemagglutinin__InfluenzaA__ABG88806
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccguucccaacaaugagaaguuugauaaacucuauauuuggggcgugcaucacccugggacagacucugaucagaucucccuguacgcgcaggccagcggaagagucaccguguccacgaagcggucucaacagacagugauuccgaacaucggcagccgccccugggucagagggguuuccagccggauuucuaucuacuggaccauugugaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugucaaacagaauacacuuaagcuggccacgggaaugcggaacgugccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguugagggccgcauucaggaccuggagaaguauguggaagauaccaaaaucgaccucugguccuacaaugccgagcugcuggucgcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacguguaccgcgacgaagcucucaauaaccgguuccagauuaagggcguugagcugaaauccggauauaaggauuggauccuuuggaucagcuuugccauuuccugcuuccugcucuguaucgugcugcugggcuuuauuaugugggccugccagaaagggaauaucagauguaacauuugcaucuga

SEQ ID NO: 184196 - RNA, 1704 nt, Artificial Sequence
  derived and/or modified sequence opt5 from hemagglutinin__InfluenzaA__ABI16504
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauuagcaaguccucuuggagcgaucaugaagccuccagcggcgugucuuccgcuugucccuaccaggggaccccuagcuuuuuccgcaauguuguguggcugaucaaaaagaacaauacauaucccaccauuaaaagaucuuacaacaauacaaaccaagaggaccuccugauccuuuggggaauccaccacuccaacaaugccgcugagcagaccaagcuguaucagaacccuacgaccuacauuagcgucggcacaucuacccucaaucugcggcuggugccgaagaucgccacacgcuccaaagugaacggccagagcgggagaauggacuuuuucuggaccauucucaagcccaaugaugcgaucaacuuugaauccaauggaaacuucauugccccugaguacgcuuauaaaaucgucaagaaaggcgauucugccaucaugaaaagcgaaguugaguacgggaauugcaacacgaaaugucaaacacccauuggagcuaucaauuccagcaugccuuuucauaacauucacccccugaccaucggcgaaugcccgaaguaugugaagucuaauaaacuugugcuggccacagggcuccggaacuccccucugcgcgagagacggcgcaagagaggacuuuucggcgcgauugccggcuuuaucgaagggggauggcagggcauggucgacgggugguacggauaucaucacagcaaugaacagggcucuggguacgcugccgacaaagagagcacccagaaggcuaucgauggagugaccaacaaaguuaacuccauuaucgacaagaugaauacacaauucgaagccgugggccgggaguuuaacaaucuggaacgcagaauugagaaccucaauaagaaaauggaggauggcuuccuggacgucuggacguauaacgccgaacugcucgugcugauggagaaugaacggacccuugauuuccacgacucuaacguuaagaaucuguacgauaaagugcgccuccagcugagagacaacgcuaaggagcuugggaauggauguuuugaguucuaccauaaaugcgauaacgaguguauggagagcguccggaauggcacauaugacuacccccaguauuccgaagaggcgagacugaagcgcgaagagaucagcggggugaagcucgagucuauuggaaccuaccaaauccuguccauuuauagcacagucgccucuucccuggcucucgccaucaugguggccggccugagccuuuggaugugcuccaacgggucucugcagugccggaucuguauuuga

SEQ ID NO: 184197 - RNA, 1701 nt, Artificial Sequence; identical to SEQ ID NO: 183657
  derived and/or modified sequence opt5 from hemagglutinin__InfluenzaA__ABI20793

SEQ ID NO: 184198 - RNA, 1701 nt, Artificial Sequence
  derived and/or modified sequence opt5 from hemagglutinin__InfluenzaA__ABI20837
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagaaaagaacggccuuuaucccaaucugucuaaguccuacgugaacaauaaagagaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgagugugacgccaagugccagaccccucaaggcgcuauuaauucuagccugcccuuucagaacgugcacccggugaccaucggggaauguccuaaauacguccgguccacaaagcuccgcauggugacgggacugagaaauauccccucuauucagagccggggccuuuucggggccaucgcuggauuuauugagggcggguggaccggaaugaucgauggcugguauggcuaccaucaccagaacgaacaaggguccggauacgccgccgaccagaaaagcacacagaaugcuauuaacggcaucaccaauaagguuaacucugugaucgagaaaaugaauacacaguucaccgcggucgggaaggaguucaacaagcuggaacgcagaauggagaaucucaacaaaaagguggaugacggauuucuggauauuuggacguauaacgccgaacugcucguucugcuugagaaugaacggacacuggacuuccacgacuccaacgugaaaaaucucuacgagaaggucaaaacccaacugaagaacaaugcuaaggagaucggcaacgggugcuuugaguucuaucauaaauguaauaacgaaugcauggaaagcgugaagaauggcaccuacgauuauccuaaauacucugaggaguccaaacuuaaccgcgagaaaauugacggagucaagcuggaaagcaugggcguguaucagauccucgccauuuacuccacaguugccucuagccuggugcugcucgucucccugggggcuaucucuuuuuggaugugcagcaauggaucccuucaguguagaaucugcauuuga

SEQ ID NO: 184199 - RNA, 1701 nt, Artificial Sequence
  derived and/or modified sequence opt5 from hemagglutinin__InfluenzaA__ABI20848
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugaaggagcaacuuucuagcguuuccagcuuugaacgguucgagaucuuucccaaggagucuuccuggccuaaucauaccgugacaaaaggagucaccgcuagcugcucucacaacggcaaguccagcuucuacaaaaaucugcucuggcugacagaaaagaacggccuuuaucccaaucugucuaaauccuacgugaacaauaaggagaaggaaguucucgugcuguggggaguccaucacccuagcaacauuggggaucagcgcgccaucuaccacaccgagaacgcgcauguguccguggucucuagccacuauuccagacgguuuacgccggaaaucgccaaacgccccaagguuagagaccaggagggccggauuaauuacuauuggacacugcucgagccuggggauaccaucauuuucgaagcuaacggaaaucugaucgcccccugguacgcuuuugcccuuagccgcggcuucgggucuggaauuaucacauccaacgcgagcaugggcgagugugacgccaaaugccagaccccucaaggcgcuauuaauucuagccugcccuuucagaacgugcauccggugaccaucggggaauguccuaaguaugucagauccacaaaacuccggauggugacgggacugcgcaauauccccucuauucagagcagaggccuuuucggggccaucgcuggauuuauugagggcggguggaccggaaugaucgauggcugguacggcuaucaccaccagaacgaacaaggguccggauacgccgccgacaagaaaagcacacagaaugcuauugauggcaucaccaacaagguuaauucugugaucgagaagaugaacacacaguucaccgcggucgggaaagaguucaauaagcuggaacggcgcauggagaaccucaauaaaaagguggacgauggauuucuggacauuuggacguacaacgccgaacugcucguucugcuugagaacgaaagaacacuggacuuccaugauuccaaugugaaaaaccucuaugagaaggucaagaaucagcugaaaaacaaugcuaaggagaucggcaacgggugcuuugaguucuaccacaaauguaauaacgaaugcauggaaagcgugaagaauggcaccuaugacuacccuaaauauucugaggaguccaaacuuaagcgggaaaagauugauggagucaagcuggagagcaugggcguguaccaaauccucgccauuuauuccaccguugccucuagccuggugcugcucgucucccugggggcuaucucuuuuuggaugugcagcaacggaucccuucagugucgcaucugcauuuga

SEQ ID NO: 184200 - RNA, 1701 nt, Artificial Sequence; identical to SEQ ID NO: 183945
  derived and/or modified sequence opt5 from hemagglutinin__InfluenzaA__ABI20859

SEQ ID NO: 184201 - RNA, 1701 nt, Artificial Sequence
  derived and/or modified sequence opt5 from hemagglutinin__InfluenzaA__ABI20870
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccugagugcgaaucccucuuuucuaaagagagcugguccuacaucgccgaaacaccgaaucccgagaacggcaccuguuauccugggaauuucgccgacuacgaggaacugcgggagcaacuuucuagcguuuccagcuuugaacgcuucgagauuuuucccaaggagucuuccuggccuaaccauacggugaccaagggagucacagugagcugcucucacaauggcaaauccagcuucuauagaaaccugcucuggcugaccgaaaagaauggccuuuaccccaaccugucuaaauccuauguuaauaacaaggagaaagaagugcucguccuguggggagugcaucacccuagcaacaugcgggaucagcgcgcuaucuaccacacagagaaugccuacguguccgucguuucuagccauuauuccagacgguuuaccccggaaaucgcgaagcgccccaaggugagagaccaggaggggcggauuaacuacuauuggacgcugcucgagccuggcgauacaaucauuuucgaagccaaugggaaccugaucgcuccccgcuacgccuuugcucuuagcagaggauucggcucugggauuaucaccuccaaugccagcauggacgagugugaugcgaaaugccagacaccucaaggagccauuaacucuagccugcccuuucagaaugugcacccggucaccaucggcgaauguccuaaguaugugcgguccaccaaacuccgcaugguuacaggccugagaaacauccccucuauucagagccgggggcuuuucggagcuaucgccggcuuuauugaagggggauggacgggcaugaucgacgggugguacggauaucaucaccagaaugaacaaggcuccggcuacgcugccgaucagaagucuacccagaacgccauuaaugggaucacaaacaaagugaauagcgucaucgagaagaugaacacccaguucacagcugugggaaaagaguucaauaagcuggaacgcagaauggagaaccucaacaagaaaguugacgauggcuuucuggacauuuggaccuacaaugcggaacugcucgugcugcuugagaacgaacggacgcuggacuuccacgauuccaaugucaagaaccucuaugagaaagucaagagccaacugaaaaauaacgccaaggagaucgggaauggaugcuuugaguucuaccauaaguguaacaaugagugcauggaaucugugaaaaacggcacauaugacuacccuaaguauuccgaggagagcaaacuuaauagagaaaagauugauggggugaaacuggaguccaugggcguuuaccagauccucgcuauuuauucuaccguggccagcucccugguccugcucgugucucugggagccaucagcuuuuggaugugcuccaacggcagccuucagugucgcaucugcauuuga

SEQ ID NO: 184202 - RNA, 1701 nt, Artificial Sequence; identical to SEQ ID NO: 184013
  derived and/or modified sequence opt5 from hemagglutinin__InfluenzaA__ABI20881

SEQ ID NO: 184203 - RNA, 1701 nt, Artificial Sequence
  derived and/or modified sequence opt5 from hemagglutinin__InfluenzaA__ABI20892
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaaggaaggauucaacuggacaggcguggcucaggacggcaagucuuaugccugcaaacggggguccgucaauagcuuuuucucucgccucaacuggcugcacaaacuugaguacaaguauccugcgcugaaugugaccaugcccaacaaugauaaguuugacaaacucuacauuuggggaguucaucacccuuccacagauagcgaccaaaccucucuguacgugcaggccuccggcagagucacggugagcacaaagcggucccagcagaccgugaucccgaacauugggucucgccccugggucagaggaaucagcucccggauuagcauccacuggacaauuguuaagccuggcgacauccugcucaucaccucuaccgggaaucugauugcuccccgcggauauuucaaaaucagaaacggcaaguccagcauuaugcggucugaugccccuaucggcaacuguaauagcgagugcauuacacccaacggguccaucccgaaugacaaaccuuuucaaaacgugaaucgcaucacguacggagcuugucccagauaugugaagcagaacacccuuaaacuggccacaggcaugcggaaugucccugaaaagcagacccgcgggauuuucggagcgaucgccggcuuuauugagaacgggugggaaggaaugguggauggcugguacggcuucagacaucaaaauucugaggggacaggacaggcugccgaccucaaaagcacccaggcugccaucgaucagauuaacggcaagcugaaucggcuuaucgagaagacgaacgaaaaauuucaccaaaucgagaaggaguucuccgaaguugaagggcgcauucaggaccuggagaaauauguggaggauacaaagaucgaccucuggagcuacaaugccgaacugcuggucgcucucgagaaccagcauaccauugaucugaccgacucugaaaugaauaaacuuuucgagagaacacggaagcagcugagagaaaacgcggaggauaugggaaacggcugcuuuaagaucuaucacaaaugugacaaugccugcauuggguccauccgcaacggcaccuacgaccacgauguguaccgggacgaggcucucaauaacagauuccaaauuaagggaguugaacugaaaagcggcuauaaggauuggauccuuuggaucucuuuugccauuuccugcuuccugcucugugugguccugcugggguuuaucaugugggccugccagaaaggaaauauucgcuguaacaucugcauuuga

SEQ ID NO: 184204 - RNA, 1701 nt, Artificial Sequence
  derived and/or modified sequence opt5 from hemagglutinin__InfluenzaA__ABI20903
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcaaaauucuccgacaggcagaauuugcgacagcccccaccggauccuggaugggaaaaacuguacccucaucgacgcccugcugggagauccucauugcgacggcuuucagaauaaggagugggaucucuucgucgaacgcuccaaagccuauucuaacuguuaccccuaugacgugccugauuacgcuagccugagaucccuuguugccucuagcgggacgcuggaguuuaccaaugaaaacuucaauuggacaggaguggcucaggacggcaaguccuaugccugcaagcggggcagcgucaacucuuucuucucccgccucaauuggcugcacaaacuugaguacaaguaucccgcgcugaacgugaccaugccuaauaacgggaaauuugauaagcucuacauuuggggaguucaucacccgagcacagacucugaucagaccucccuguacgugagagccagcggcaaagucacggugucuacaaagcggucccagcagaccgugauccccgacauuggguaucgcccuugggucagaggacugagcucccggaucucuauuuacuggacaaucguuaagcccggcgacauucuccugauccacagcaccgggaaccuuaucgcuccucgcggauauuucaaaauuagaaauggcaaguccagcaucaugcggucugaugcccccauuggcaacuguuccagcgagugcaucaccccgaaugggucuauuccuaacgacaaacccuuucagaaugugaaccgcaucacauacggagcuuguccuagauaugugaagcaaaauacgcugaaacucgccaccggcaugcggaacguccccgaaaagcagacacgcgggaucuucggagcgauugccggcuuuaucgagaaugggugggaaggaaugguggauggcugguacggcuucagacaucagaacagcgaggggaccggacaggcugccgaccugaaauccacacaagcugccauugaucagaucaauggcaaacuuaaccggcugguugagaagaccaaugaaaaguuucaccagauugagaaggaauuuucugagguggaagggagaauccaagaccucgagaaauaugucgaggauacgaagaucgaccuguggagcuacaacgccgaacugcucguggcucuggagaaucagcauacaauugaucuuaccgacuccgaaaugaacaaacuguucgagcgcacccggaagcagcucagagaaaacgcggaggauaugggaaauggcugcuuuaagaucuaccacaaaugugacaacgccugcauugggagcauccgcaauggcacauaugaccacgauguuuaccgggacgaggcucugaacaauagauuccagauuaagggaguggaacuuaaaucuggcuauaaggauuggauccuguggauuuccuuugccaucagcugcuuccuccugugugucgugcugcucggguuuaucaugugggccugccaaaaaggaaacauucgcuguaauaucugcauuuga

SEQ ID NO: 184205 - RNA, 1701 nt, Artificial Sequence
  derived and/or modified sequence opt5 from hemagglutinin__InfluenzaA__ABI20914
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucgaucagauuaauggcaaacugaacagacugaucgagaagacaaaugaaaaguuccaucagaucgagaaagaguucuccgaaguugaagggcgcauucaagaccucgagaaguacguggaggauaccaaaaucgaccuguggagcuauaacgccggacugcucgucgcucuggaaaaucagcacacgauugaucuuacagacucugagaugaacaagcuguuugaacggaccagaaaacagcuccgcgagaacgcggaagauaugggcaaugggugcuucaagaucuaccauaagugugacaacgccugcauuggcuccauccggaauggaaccuacgaccacgauguguauagagacgaggcucugaacaaucgcuuucagauuaaaggcguugagcuuaagagcggguacaaagauuggauccuguggaucucuuucgccauuuccugcuuucuccuguguguggucagccugggauucaucaugugggccugccaaaagggcaacauucgguguaauaucugcauuuga

SEQ ID NO: 184206 - RNA, 1701 nt, Artificial Sequence; identical to SEQ ID NO: 184090
  derived and/or modified sequence opt5 from hemagglutinin__InfluenzaA__ABI20925

SEQ ID NO: 184207 - RNA, 1701 nt, Artificial Sequence; identical to SEQ ID NO: 184090
  derived and/or modified sequence opt5 from hemagglutinin__InfluenzaA__ABI20936

SEQ ID NO: 184208 - RNA, 1701 nt, Artificial Sequence
  derived and/or modified sequence opt5 from hemagglutinin__InfluenzaA__ABI20947
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucggguucagacccuggguccggggacugucuagccgcauuuccaucuauuggaccauuguuaagccuggcgacauccuccugaucaacagcacagggaaccuuauugcucccagaggauacuuuaagauccggaauggcaaaucuuccauuaugcgcagcgaugccccuaucggcaacuguucuagcgagugcauuacccccaauggguccaucccgaacgacaagccuuuccagaaugugaacagaaucaccuauggagcuuguccccgguacgugaaacaaaauacacugaagcucgccacgggcaugcgcaacgucccugaaaaacagaccagagggauuuuuggagcgaucgccggcuucauugagaaugggugggaaggaaugguggauggcugguauggcuuucggcaccagaacucugaggggacaggacaggcugccgaccuuaagagcacccaagcugccaucgaucagauuaauggcaaacugaacagacugaucgagaagacaaaugaaaaguuccaucagaucgagcaagaguucuccgaaguugaagggcgcauucaggaccucgagaaauacguggaggauaccaagaucgaccuguggagcuauaacgccggacugcucgucgcucuggaaaaucagcacacgauugaucuuacagacucugagaugaacaaacuguuugaacggaccagaaagcagcuccgcgagaacgcggaagauaugggcaaugggugcuucaaaaucuaccauaagugugacaacgccugcauuggcuccauccggaauggaaccuacgaccacgauguguauagagacgaggcucugaacaaucgcuuucaaauuaagggcguugagcuuaaaagcggguacaaggauuggauccuguggaucucuuucgccauuuccugcuuucuccugugugugguccugcucggauucaucaugugggccugccagaaaggcaacauucgguguaauaucugcauuuga

SEQ ID NO: 184209 - RNA, 1701 nt, Artificial Sequence
  derived and/or modified sequence opt5 from hemagglutinin__InfluenzaA__ABI20958
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcuguacaaacuugaguauaaguacccugcgcugaacgugacaaugcccaauaacgggaaauuugacaagcucuacaucuggggaguucaccauccuuccaccgauagcgaccaaacaucucuguaugugagagccuccggccgggucaccgugagcacgaaacgcucccagcagacagugauuccgaauaucggguucagacccuggguccggggacugucuagccgcauuuccaucuacuggaccauuguuaagccuggcgacauccuccugaucaacagcacagggaaccuuauugcucccagaggauauuuuaagauccggaauggcaaaucuuccauuaugcgcagcgaugccccuaucggcaacuguucuagcgagugcauuacccccaauggguccaucccgaacgacaagccuuuccagaaugugaacagaaucaccuacggagcuuguccccgguaugugaaacaaaauacacugaagcucgccacgggcaugcgcaacgucccugaaaaacagaccagagggauuuuuggagcgaucgccggcuucauugagaaugggugggaaggaaugguggauggcugguacggcuuucggcaccagaacucugaggggacaggacaggcugccgaccuuaagagcacccaagcugccaucgaucagauuaauggcaaacugaacagacugaucgagaagacaaaugaaaaguuccaccagaucgagaaagaguucuccgaaguugaagggcgcauucaagaccucgagaaguauguggaggauaccaaaaucgaccuguggagcuacaacgccggacugcucgucgcucuggaaaaucagcauacgauugaucuuacagacucugagaugaacaagcuguuugaacggaccagaaaacagcuccgcgagaacgcggaagauaugggcaaugggugcuucaagaucuaccacaagugugacaacgccugcauuggcuccauccggaauggaaccuaugaccaugauguguacagagacgaggcucugaacaaucgcuuucagauuaaaggcguugagcuuaagagcggguauaaagauuggauccuguggaucucuuucgccauuuccugcuuucuccugugugugguccugcucggauucaucaugugggccugccaaaagggcaacauucgguguaauaucugcauuuga

SEQ ID NO: 184210 - RNA, 1701 nt, Artificial Sequence
  derived and/or modified sequence opt5 from hemagglutinin__InfluenzaA__ABI20969
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaauggaaucucuucguggagcggagcacggccuauuccaacuguuacccuuaugauguucccgacuacgcuucucugcgcagccuuguggccuccagcggcacccuggaauuuaauaacgagucuuucaauuggacaggggucgcucagaacggaaccuccagcgccugcaagagacggucuauuaaauccuuuuucagccgccucaauuggcugcaucaacuuaaguauaaguacccugcgcugaacgugacaaugcccaauaacgagaaauuugauaagcucuauaucuggggcguucaccacccuucuaccgacuccgaucagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgacauccugcucauuaauagcaccgggaaccugaucgcuccccgcggauauuucaaaauuagaucuggcaagagcuccaucaugcggucuaaugccccuauugggaaguguaacagcgaaugcaucacccccaauggauccaucccgaacgauaaaccuuuucagaaugugaaccgcauuacauacggcgccugucccagauaugugaagcagaauacgcuuaaacuggcgaccggcaugcggaacgucccugagaagcagacacgcgggaucuucggagccauugcuggcuuuaucgaaaaugggugggagggaaugguggacggcugguacggguucagacaucaaaacagcgagggaaccggccaggccgcugaccucaaaucuacacaggccgccauuaaucaaaucaacggcaagcugaaucggcuuaucgagaaaaccaacgaaaaguuucaccagauugaaaaggaguucuccgaaguugaggggagaauccaggaucuggagaaauauguggaagacacgaagauugaucucuggagcuacaacgcugagcugcuggucgcgcucgaaaaucagcauacaaucgaccugaccgauucugagaugaacaaacuuuucgaacgcacccggaagcaacugagagagaaugccgaggacaugggaaacggcugcuuuaaaauuuaucacaagugugauaaugcuugcaucggguccauucgcaacggaacauacgaccacgauguguaccgggacgaagcccucaauaacagauuccagaucaagggcguugagcugaaaagcggguauaaggauuggauccuuuggauuuccuuugccaucucuugcuuccugcucugugugguccugcugggcuuuauuaugugggcuugccagaaaggaaauauccgcuguaacauuugcaucuga

SEQ ID NO: 184211 - RNA, 1701 nt, Artificial Sequence
  derived and/or modified sequence opt5 from hemagglutinin__InfluenzaA__ABI20980
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgaccagaauggaaccuccagcgcuugcaagagacggucuacaaaauccuuuuucagccgccucaacuggcugcaucaacuuaaguauaaguacccugcccugaaugugaccaugcccaacaaugagaaauuugauaagcucuauauuuggggcguucaccacccuucuacggacuccgaucagaucagccuguacgcgcaggccuccggcagagugacagucucuaccaaacggagccagcaaacagugaccccgaacauugggucccgccccugggugagaggagucagcucucggaucuccauuuacuggaccaucguuaagccuggcgacauucugcucaucaacagcacagggaaucugaucgcuccccgcggauauuucaaaauuagaucuggcaagagcuccaucaugcggucuaacgcccuuauugggaaguguaauagcgaaugcaucacgccuaacggauccauucccaaugacaaaccguuucagaacgugaaucgcaucaccuacggcgcuuguccuagauaugugaagcagaacacacugaaacucgccaccggcaugcggaauguccccgagaagcagacacgcgggaucuucggagcgauugccggcuuuaucgaaaacgggugggagggaaugguggauggcugguacggguucagacaucaaaauagcgagggaaccggccaggcugccgaccugaaaucuacgcaggcugccauuaaccaaaucaauggcaaacuuaaccggcugauugaaaagacaaaugagaaguuucaccagaucgaaaaggaguucuccgaaguugaggggagaauccaggaucucgagaaauauguggaagacaccaagauugaucuguggagcuacaacgccgagauccuggucgcucucgaaaaccagcauaccauugaccugacagauucugagaugaauaaacuuuucgaacgcacccggaagcaacugagagagaacgcggaggacaugggaaauggcugcuuuaaaaucuaucacaagugugauaacgccugcauuggguccauccgcaauggaacauacgaccacgauguguaccgggacgaagcucucaacaauagauuccagauuaagggcguugagcugaaaagcggguauaaggacuggauccuuuggaucuccuuugccauuucuugcuuccugcucugugugguccugcugggcuuuaucaugugggccugccagaaaggaaacauucgcuguaauaucugcauuuga

SEQ ID NO: 184212 - RNA, 1701 nt, Artificial Sequence
  derived and/or modified sequence opt5 from hemagglutinin__InfluenzaA__ABI20991
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaucaauaaacuuuucgaaagaaccaagaagcagcugcgcgagaacgccgaggacauggggaauggauguuuuaagauuuaucauaaaugcgauaacgcuugcaucggcucuauucggaaugggaccuacgaccacgaugucuacagagacgaagcccucaacaaucgcuuccagaucaagggcguggagcugaaauccggauauaaggacuggauccuuuggauuagcuuugccaucuccuguuuccugcucugcguugugcugcugggcuuuauuaugugggcuugucagaaagggaacauccggugcaauauuuguaucuga

SEQ ID NO: 184213 - RNA, 1701 nt, Artificial Sequence; identical to SEQ ID NO: 183734
  derived and/or modified sequence opt5 from hemagglutinin__InfluenzaA__ABI21002

SEQ ID NO: 184214 - RNA, 1701 nt, Artificial Sequence; identical to SEQ ID NO: 184178
  derived and/or modified sequence opt5 from hemagglutinin__InfluenzaA__ABI21013

SEQ ID NO: 184215 - RNA, 1701 nt, Artificial Sequence; identical to SEQ ID NO: 183664
  derived and/or modified sequence opt5 from hemagglutinin__InfluenzaA__ABI21024

SEQ ID NO: 184216 - RNA, 1701 nt, Artificial Sequence; identical to SEQ ID NO: 183540
  derived and/or modified sequence opt5 from hemagglutinin__InfluenzaA__ABI21035

SEQ ID NO: 184217 - RNA, 1701 nt, Artificial Sequence
  derived and/or modified sequence opt5 from hemagglutinin__InfluenzaA__ABI21046
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacaacgaucagauuucucucuaugcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguacuucaagaucagauccggaaaaagcucuauuaugcggagcgaugccccuaucggcaaguguaauuccgagugcaucacacccaacggcucuauuccgaaugacaaaccuuuucagaacgucaaucgcaucacguauggggcuugucccagauacguuaagcagaacacccugaaacuugccacaggaaugcggaaugugccugaaaagcaaacccgcggcauuuucggggcgaucgccggauuuauugagaacggcugggaagggaugguggauggaugguauggcuucagacaccagaauagcgagggcacagggcaggcugccgaccugaaauccacccaagcugccaucaaccagaucaauggaaagcucaaccggcugauuggcaagacgaaugagaaauuucaucagaucgaaaaggaguucagcgaagucgaggggcgcauucaggaucuugaaaaauacguggaggacacaaagaucgaucuguggucuuauaacgccgagcuccugguugcucuggaaaaccaacacaccauugaccucaccgauuccgagaugaauaaacuguucgaaagaacaaagaagcagcuucgggagaacgcggaagacaugggaaauggcugcuuuaaaaucuaccauaagugugauaacgccugcauugggagcaucagaaauggcaccuaugaccacgacguguaccgcgaugaggcucugaacaaucgguuccagaucaaaggagucgagcucaagucuggcuacaaagacuggauucuguggaucuccuuugccauuagcugcuuccuucuguguguggcccuccugggguuuaucaugugggcuugccagaagggaaacauuagauguaauaucugcaucuga

SEQ ID NO: 184218 - RNA, 1701 nt, Artificial Sequence
  derived and/or modified sequence opt5 from hemagglutinin__InfluenzaA__ABI21057
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgggaucugcgacuccccgcaccagauccuugauggagagaacuguacccugauugacgcccuccugggcgauccccagugcgacggguuucagaauaaaaagugggaucuguucgucgaaagaucuaaagccuauagcaacuguuacccuuaugacgugcccgaucaugcuucccuccggucucugguugccagcuccggaacgcuugaguuuaauaacgaaucuuucgacuggaccggcgugacacagaauggcaccucuuccgcuugcaagcgcagaagcaacaagagcuuuuucucccggcugaauuggcucacacaccugaaauacaaguauccugcccuuaacgucaccaugcccaauaacgagaaauuugauaagcuguacaucuggggagugcaucacccugggacggacagcgaucagauuucucucuaugcgcaggccuccggccgcaucacaguuagcaccaaaagaucccaacagacagugauuccgaacaucgggucucggccccgcgucagagacgugagcucccggauuagcaucuacuggaccaucgugaagccuggagacauucugcugaucaauucuaccggcaaccucauugcuccccgcggguacuucaagaucagauccggaaaaagcucuauuaugcggagcgaugccccuaucggcaaguguaauuccgagugcaucacacccaacggcucuauuccgaaugacaaaccuuuucagaacgucaaucgcaucacguauggggcuugucccagauacguuaagcagaacacccugaaacuugccacaggaaugcggaaugugccugaaaagcaaacccgcggcauuuucggggcgaucgccggauuuauugagaacggcugggaagggaugguggauggaugguauggcuucagacaccagaauagcgagggcacagggcaggcugccgaccugaaauccacccaagcugccaucaaccagaucaauggaaagcucaaccggcugauuggcaagacgaaugagaaauuucaucagaucgaaaaggaguucagcgaagucgaggggcgcauucaggaucuugaaaaauacguggaggacacaaagaucgaucuguggucuuauaacgccgagcuccugguugcucuggaaaaccaacacaccauugaccucaccgauuccgagaugaauaaacuguucgaaagaacaaagaagcagcuucgggagaacgcggaagacaugggaaauggcugcuuuaaaaucuaccauaagugugauaacgccugcauugggagcaucagaaauggcaccuaugaccacgacguguaccgcgaugaggcucugaacaaucgguuccagaucaaaggagucgagcucaagucuggcuacaaagacuggauucuguggaucuccuuugccauuagcugcuuccuucuguguguggcccuccugggguuuaucaugugggcuugccagaagggaaacauuagauguaauaucugcaucuga

SEQ ID NO: 184219 - RNA, 1701 nt, Artificial Sequence; identical to SEQ ID NO: 183267
  derived and/or modified sequence opt5 from hemagglutinin__InfluenzaA__ABI21068

SEQ ID NO: 184220 - RNA, 1701 nt, Artificial Sequence; identical to SEQ ID NO: 183306
  derived and/or modified sequence opt5 from hemagglutinin__InfluenzaA__ABI21079

SEQ ID NO: 184221 - RNA, 1701 nt, Artificial Sequence; identical to SEQ ID NO: 184137
  derived and/or modified sequence opt5 from hemagglutinin__InfluenzaA__ABI21090

SEQ ID NO: 184222 - RNA, 1701 nt, Artificial Sequence; identical to SEQ ID NO: 184137
  derived and/or modified sequence opt5 from hemagglutinin__InfluenzaA__ABI21101

SEQ ID NO: 184223 - RNA, 1701 nt, Artificial Sequence
  derived and/or modified sequence opt5 from hemagglutinin__InfluenzaA__ABI21123
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuucucucuaugcgcaggccuccggccgcaucacaguuagcaccaagagaucccaacagacagugauuccgaauaucgggucucggccccgcgucagagacauuccuagccggaucuccaucuacuggaccauugugaaacccggagauauccugcugauuaacagcaccggcaaucucaucgcuccucgcggguacuuuaagauuagaucuggaaaguccagcaucaugcggucugacgcccccaucggcaaauguaacagcgagugcauuacaccgaauggcuccaucccuaacgacaagcccuuccagaaugugaaccgcauuacguauggggcuuguccuagauacgucaaacagaauacccugaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacucaaccggcugauuggcaagaccaaugagaaguuccaccagaucgaaaaagaguucuccgaaguggaggggcgcauucaggaucuugaaaagcaugucgaggacacgaaaaucgaucuguggagcuacaacgccgagcuccugguggcucuggaaaaucaacacacaauugaccucaccgauucugagaugaacaagcuguuugaaagaaccaaaaagcagcuucgggagaaugcggaagacaugggaaacggcugcuucaagaucuaucauaaaugugauaaugccugcaucggguccauuagaaacggcacauacgaccacgauguuuaucgcgacgaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 184224 - RNA, 1701 nt, Artificial Sequence
  derived and/or modified sequence opt5 from hemagglutinin__InfluenzaA__ABI21134
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgggauuugcgacucuccgcaccagauccuugauggagagaauuguacccugauggacgcccuccugggcgauccccagugcgacggguuucaaaacaaaaagugggaucuguucguggaaagaagcaaagccuauuccaauuguuacccuuaugacguucccgauuacgcuucucuccggagccugguggccuccagcggaacgcuugaguuuaacaaugaaucuuucaacuggaccggcgucacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacaucuggggaguucaccauccugggacggauaaugaccagauuucucucuaugcgcaggccuccggccgcaucacagugagcaccaagagaucccaacagacagucauuccgaacaucgggucucggagccgcgugagagauauucccucccggaucagcauuuacuggaccaucgugaaaccuggagacauccugcugauuaauucuaccggcaaccucaucgcuccccgcggguacuuuaagauuagauccggaaagagcucuaucaugcggagcgacgccccuauuggcaaauguaauuccgagugcaucacacccaacggcucuaucccgaaugauaagccuuuccagaacgucaaucgcauuacguauggggcuugucccagauacguuaaacagaacacccugaaacuugccacaggaaugcggaaugugccugaaaaacaaacccgcggcaucuuuggggcgauugccggauucaucgagaacggcugggaagggaugguggacggaugguauggcuuuagacaccagaauagcgagggcacagggcaggcugccgaucugaaguccacccaagcugccauuaaccagaucaauggaaaacucaaccggcugaucggcaagacgaacgagaaguuccaccagauugaaaaagaguucagcgaagucgaggggagaauccaggaccuugaaaaguacguggaggauacaaaaauugaccuguggucuuauaaugccgagcuccugguugcucuggaaaaccaacauaccaucgaucucaccgacuccgagaugaauaagcuguuugaacgcacaaagaagcagcuucgggagaacgcggaagauaugggaaauggcugcuucaagauuuaccacaaaugugacaacgccugcaucgggagcauuagaaauggcaccuaugaucaugacguguaccgcgacgaggcucugaacaaucgguuucagaucaagggagucgagcucaaaucuggcuacaaggauuggauccuguggauuuccuucgccaucagcugcuuucuucuguguguggcccuccugggguucauuaugugggcuugccagaaaggaaacaucagauguaauauuugcaucuga

SEQ ID NO: 184225 - RNA, 1701 nt, Artificial Sequence; identical to SEQ ID NO: 183306
  derived and/or modified sequence opt5 from hemagglutinin__InfluenzaA__ABI21156

SEQ ID NO: 184226 - RNA, 1701 nt, Artificial Sequence
  derived and/or modified sequence opt5 from hemagglutinin__InfluenzaA__ABI21167
augaagaccaucauugcccugggcuacauccucugccugguguucgcucagaaacuucccgggaacgacaauagcacagccacgcugugucucggacaccaugcggucccuaacggcaccauuguuaagacaaucaccaaugaucaaauugaggugacaaacgcuaccgaacuggugcaguccucuagcacagggggaaucugcgacuccccgcaccagauccuugauggcgagaauuguacccugauugacgcccuccugggggauccccagugcgacggauuucaaaacaaaaagugggaucuguucgucgaaagaucuaaagccuauagcaauuguuacccuuaugacgugcccgauuacgcuucccuccggucucugguugccagcuccggcacgcuugaguuuaacaaugaaucuuucaacuggaccggcgugacacagaaugggaccucuuccgcuugcaagcgcagaagcaacaauagcuuuuucucccggcugaacuggcucacacaucugaaguuuaaauauccugcccuuaaugucaccaugcccaacaacgagaaguucgacaaacuguacaucuggggagugcaccauccuggcacgaauaacgaucagauuagccucuaugcgcaggccucugggcgcaucacaguuuccaccaagagaagccaacagacagugauuccgaauaucggaucccggccccgcgucagagacauuccuucucggaucagcaucuacuggaccauugugaaacccggcgauauccugcugauuaacuccaccgggaaucucaucgcuccucgcggauacuuuaagauuagaagcggcaagucuuccaucaugcggagcgacgcccccaucggcaaauguaacucugagugcauuacaccgaaugggagcaucccuaacgacaagcccuuccagaaugugaaccgcauuacguauggagcuuguccuagauacgucaaacagaauacccugaaacuugccacaggcaugcggaacguucccgaaaagcaaacccgcgggaucuuuggagcgauugccggcuucaucgagaaugggugggaaggaaugguggauggcugguauggcuuuagacaccagaacuccgaggggaucggacaggcugccgaccugaagucuacacaagcugccauuaaucagaucaacggcaaacucaaccggcugauugggaagaccaaugagaaguuccaccagaucgaaaaagaguucagcgaaguggagggacgcauucaggaucuugaaaaguacgucgaggacacgaaaaucgaucugugguccuauaacgccgagcuccugguggcucuggaaaaucaacauacaauugaccucaccgauagcgagaugaacaagcuguuugaaagaaccaaaaagcagcuucgggagaaugcggaagacaugggcaacgggugcuucaagaucuaccacaaaugugauaaugccugcaucggcucuauuagaaacggaacauaugaccaugagguuuaccgcgaugaggcucugaauaaccgguuucagaucaagggcguggaacucaaauccggguacaaggacuggauucuguggaucagcuucgccauuucuugcuuucuucugugugucgcccuccugggauucaucaugugggcuugccagaaaggcaauaucagauguaacauuugcaucuga

SEQ ID NO: 184227 - RNA, 1701 nt, Artificial Sequence
  derived and/or modified sequence opt5 from hemagglutinin__InfluenzaA__ABI21178
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccucuuguuacccuuaugacgugcccgauuacgcuagccuccggucccugguugccagcucuggaacgcuugaguuuaauaacgaauccuucaauuggaccggcgugacacagaacggcaccagcucugcuugcaagcgcagauccaauaacagcuuuuucucucggcugaauuggcucacacaucugaaguuuaaauauccugcccuuaacgucaccaugcccaauaacgagaaguucgacaaacuguacaucuggggagugcaccauccugggacgaacaaugaucagauuucccucuaugcgcaggccagcggccgcaucacaguuuccaccaagagaucucaacagacagugauuccgaacaucgggagccggccccgcgucagagacauuccuucccggaucagcaucuacuggaccauugugaaacccggagauauccugcugauuaauucuaccggcaaccucaucgcuccucgcggguacuuuaagauuagauccggaaagagcucuaucaugcggagcgacgcccccaucggcaaauguaauuccgagugcauuacaccgaacggcucuaucccuaaugacaagcccuuccagaacgugaaucgcauuacguauggggcuuguccuagauacgucaaacagaacacccugaaacuugccacaggaaugcggaauguucccgaaaagcaaacccgcggcaucuuuggggcgauugccggauucaucgagaacggcugggaagggaugguggauggaugguauggcuuuagacaccagaauagcgagggcaucgggcaggcugccgaccugaaguccacacaagcugccauuaaccagaucaauggaaaacucaaccggcugauuggcaagaccaacgagaaguuccaccagaucgaaaaagaguucagcgaaguggaggggcgcauucaggaucuugaaaaguacgucgaggacacgaaaaucgaucuguggucuuauaaugccgagcuccugguggcucuggaaaaccaacauacaauugaccucaccgauuccgagaugaauaagcuguuugaaagaaccaaaaagcagcuucgggagaacgcggaagacaugggaaauggcugcuucaagaucuaccacaaaugugauaacgccugcaucgggagcauuagaaauggcacauaugaccaugauguuuaccgcgacgaggcucugaacaaucgguuucagaucaagggaguggagcucaaaucuggcuacaaggacuggauucuguggaucuccuucgccauuagcugcuuucuucugugugucgcccuccugggguucaucaugugggcuugccagaaaggaaacaucagauguaauauuugcaucuga

SEQ ID NO: 184228 - RNA, 1698 nt, Artificial Sequence
  derived and/or modified sequence opt5 from hemagglutinin__InfluenzaA__ABI21200
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaaugguuaccggacuccggaauauucccagcauccagucccgcggccuguucggggcuauugccggauuuaucgaaggcggguggacaggaaugguggacggcugguacggcuaucaucaccagaacgagcaagggucuggauacgcugccgaucagaaaagcacgcagaaugccauuaacggcaucaccaauaaggucaacuccgugaucgaaaagaugaauacacaguucaccgcuguugggaaagaguucaacaaacuggagagacggauggaaaaucucaacaagaagguggacgauggauuucuggacauuuggacauacaacgcggagcuucugguccuccuggaaaaugagcgcacccuugacuuccacgauagcaacgugaaaaaucuguaugaaaaggucaaaucucaacucaagaacaaugccaaagagaucggcaacgggugcuuugaguucuaccauaaguguaaugacgaaugcauggaguccgugaagaacggcacguaugauuaccccaaauauagcgaagagucuaagcugaauagagagcggauugacggaguuaaacuggaauccaugggcguguaccagauccucgcuauuuauagcacagucgccuccucucuggugcuucugguuagccucggggccaucuccuuuuggaugugcucuaacggaagccugcaguguagaaucugcauuuga

SEQ ID NO: 184229 - RNA, 1698 nt, Artificial Sequence; identical to SEQ ID NO: 184228
  derived and/or modified sequence opt5 from hemagglutinin__InfluenzaA__ABI21211

SEQ ID NO: 184230 - RNA, 1698 nt, Artificial Sequence
  derived and/or modified sequence opt5 from hemagglutinin__InfluenzaA__ABI21233
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucaauuccgucucuagcuucgaacgguuugagaucuuccccaaggaguccagcuggccuaaccauaccgugacaggaguuucugccuccugcagccacaauggcaagucuuccuuuuaccgcaaccugcuuuggcugaccggcaaaaaugggcucuaucccaaccugagcaagucuuacgcuaauaacaaagaaaaggaggugcugguccucuggggagugcaucacccuccgaacaucggcgaucagagagcccuguaccacacagaaaaugcuuauguguccgucguuagcucccauuacucucggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggauccggcaucauuaccagcaaugcucccauggacgaaugugaugccaagugccagacaccgcaaggcgcgaucaacucuucccuuccuuuucagaaugugcaccccgucaccaucggggaguguccuaaauaugugcgcagcgccaagcugagaaugguuaccggacuccggaacauucccucuauccagagccgcggccuguucggggcuauugccggauuuaucgaaggcggguggacaggaaugguggacggcugguacggcuaucaucaccagaaugagcaaggguccggauacgcugccgaucagaaaucuacgcagaacgccauuaauggcaucaccaacaaggucaauagcgugaucgaaaagaugaacacacaguucaccgcuguugggaaagaguucaauaaacuggagagacggauggaaaaccucaacaagaagguggacgauggauuucuggacauuuggacauacaaugcggagcuucugguccuccuggaaaacgagcgcacccuugacuuccacgauuccaaugugaaaaaccuguaugaaaaggucaaaagccaacucaagaauaacgccaaagagaucggcaaugggugcuuugaguucuaccauaaguguaacgacgaaugcauggagucugugaagaauggcacguaugauuaccccaaauauuccgaagagagcaagcugaacagagagcggauugacggaguuaaacuggaaucuaugggcguguaccagauccucgcuauuuauuccacagucgccagcucccuggugcuucugguuucucucggggccaucagcuuuuggaugugcuccaauggaucucugcaguguagaaucugcauuuga

SEQ ID NO: 184231 - RNA, 1701 nt, Artificial Sequence
  derived and/or modified sequence opt5 from hemagglutinin__InfluenzaA__ABI21244
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcugaaguuuauuaacgaggacuucaauuggaccggaguggcucaggauggcaagucuuaugccugcaaacggggcuccgucaacagcuuuuucucucgccucaauuggcugcacaaacuugaauacaaguauccugcgcugaacgugacaaugcccaauaacgggaaguuugacaaacucuacaucuggggaguucaucacccuuccaccgauagcgaccaaacaucucuguacgugagagccuccggccgggucaccgugagcacgaagcgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaaaauccgguccggcaagagcucuauuaugcgcagcgaugccccuaucggcaauuguuccucugagugcauuacccccaacgggagcaucccgaaugacaaaccuuuucagaacgugaauagaaucaccuauggagcuuguccccgguacgugaagcaaaacacacugaaacucgccacgggcaugcgcaaugucccugagaagcagaccagagggauuuucggagcgaucgccggcuuuauugaaaacgggugggagggaaugguggauggcugguauggcuuccggcaccaaaauuccgaagggacaggacaggcugccgaccugaaaagcacccaggcugccaucgaucagauuaacggcaaacuuaauagacugaucgagaagacaaacgagaaguuucaucagaucgaaaaggaguucucugaaguugaggggcgcauucaagaccucgaaaaauacguggaggauaccaagaucgaccugugguccuauaaugccgagcugcucgucgcucuggaaaaccagcacacgauugaucuuacagacagcgagaugaauaaacuguucgaacggaccagaaagcagcuccgcgagaacgcggaagauaugggaaacggcugcuuuaagaucuaccauaaaugugacaaugccugcauugggucuauccggaacggcaccuacgaccacgauguguauagagacgaggcucugaauaaccgcuuccagauuaagggaguugagcuuaaauccggcuacaaggauuggauccuguggaucagcuuugccauuuccugcuuccuccugugugugguccugcucggguuuaucaugugggccugccaaaaaggaaauauucgguguaacaucugcauuuga

SEQ ID NO: 184232 - RNA, 1701 nt, Artificial Sequence; identical to SEQ ID NO: 184077
  derived and/or modified sequence opt5 from hemagglutinin__InfluenzaA__ABI21255

SEQ ID NO: 184233 - RNA, 1701 nt, Artificial Sequence; identical to SEQ ID NO: 184077
  derived and/or modified sequence opt5 from hemagglutinin__InfluenzaA__ABI21266

SEQ ID NO: 184234 - RNA, 1701 nt, Artificial Sequence; identical to SEQ ID NO: 184077
  derived and/or modified sequence opt5 from hemagglutinin__InfluenzaA__ABI21277

SEQ ID NO: 184235 - RNA, 1701 nt, Artificial Sequence
  derived and/or modified sequence opt5 from hemagglutinin__InfluenzaA__ABI21299
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgacaaauuugauaagcucuacaucuggggaguucaucacccuuccaccgacagcgaccaaacaucucuguacgugagagccuccgggcgggucaccgugagcacgaaacgcucccagcagacagugauuccgaauaucggcucuagacccuggguccgggggcugagcucccgcauuagcaucuauuggaccauuguuaagccuggagauauccuccugaucaacucuacaggcaaccuuauugcucccagaggguacuucaagauccggaauggaaaauccagcauuaugcgcucugacgccccuaucggcaacuguagcuccgagugcauuacccccaauggcucuaucccgaacgauaagccuuuucagaaugugaacagaaucaccuauggggcuuguccccgguacgugaaacaaaauacacugaagcucgccacgggaaugcgcaacgucccugaaaaacagaccagaggcauuuucggggcgaucgccggauuuauugagaauggcugggaagggaugguggacggaugguauggcuuccggcaccagaacagcgagggcacagggcaggcugccgaucugaaguccacccaagcugccaucgaccagauuaauggaaaacuuaacagacugaucgagaagacaaaugaaaaguuucaucagaucgagaaagaguucagcgaaguugaaggccgcauucaagaucucgagaaguacguggaggacaccaaaaucgaucuguggucuuauaacgccgaacugcucgucgcucuggagaaucagcacacgauugaccuuacagauuccgaaaugaacaagcuguucgagcggaccagaaaacagcuccgcgaaaacgcggaggacauggggaauggaugcuuuaagaucuaccauaagugugacaacgccugcauuggcagcauccggaaugggaccuacgaucacgacguguauagagaugaggcucugaacaaucgcuuccagauuaaaggcguugaacuuaagucuggauacaaagacuggauccuguggaucuccuuugccauuagcugcuuccuccugugugugguccugcucggcuuuaucaugugggccugccaaaaggggaacauucgguguaauaucugcauuuga

SEQ ID NO: 184236 - RNA, 1701 nt, Artificial Sequence; identical to SEQ ID NO: 184077
  derived and/or modified sequence opt5 from hemagglutinin__InfluenzaA__ABI21310

SEQ ID NO: 184237 - RNA, 1701 nt, Artificial Sequence
  derived and/or modified sequence opt5 from hemagglutinin__InfluenzaA__ABI21321
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagcugccaucgaucagauuaauggcaaacuuaacagacugaucgagaagacaaaugaaaaguuucaucagaucgagaaagaguucagcgaaguugaagggcgcauucaagaccucgagaaguacguggaggauaccaaaaucgaccuguggucuuauaacgccgaacugcucgucgcucuggagaaucagcacacgauugaucuuacagacuccgaaaugaacaagcuguucgagaaaacccggaagcagcucagagaaaacgcggaggauaugggaaauggcugcuuuaagaucuaccauaaaugugacaacgccugcauugggagcauccgcaauggcaccuacgaccacgauguguaucgggacgaggcucugaacaauagauuccagauuaagggaguugaacuuaaaucuggcuacaaggauuggauccuguggaucuccuuugccauuagcugcuuccuccugugugugguccugcucggguuuaucaugugggccugccaaaaaggaaacauucgcuguaauaucugcauuuga

SEQ ID NO: 184238 - RNA, 1701 nt, Artificial Sequence
  derived and/or modified sequence opt5 from hemagglutinin__InfluenzaA__ABI21332
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugcaggccuccggcagagucaccgugagcacgaaacggucccagcagacagugauuccgaauaucgggucucgccccugggucagaggacugagcucccggauuagcaucuauuggaccauuguuaagccuggcgacauccuccugaucaacucuacagggaaccuuauugcuccccgcggauacuucaagaucagaaauggcaaauccagcauuaugcggucugaugccccuaucggcaacuguagcuccgagugcauuacccccaaugggucuaucccgaacgacaagccuuuucaaaaugugaaccgcaucaccuauggagcuugucccagauacgugaaacagaauacacugaagcucgccacgggcaugcggaacgucccugaaaaacagacccgcgggauuuucggagcgaucgccggcuuuauugagaaugggugggaaggaaugguggauggcugguauggcuucagacaccagaacagcgaggggacaggacaagcugccgaccugaaguccacccaggcugccaucgaucagauuaauggcaaacuuaaccggcugaucgagaagacaaaugaaaaguuucaucaaaucgagaaagaguucagcgaaguugaagggcgcauucaggaccucgagaaguacguggaggauaccaaaaucgaccuguggucuuauaacgccgaacugcucgucgcucuggagaaucagcacacgauugaucuuacagacuccgaaaugaacaagcuguucgagagaacccggaaacagcucagagaaaacgcggaggauaugggaaauggcugcuuuaagaucuaccauaagugugacaacgccugcauugggagcauccgcaauggcaccuacgaccacgauguguaucgggacgaggcucugaacaauagauuccaaauuaaaggaguugaacuuaagucuggcuacaaagauuggauccuguggaucuccuuugccauuagcugcuuccuccugugugugguccugcucggguuuaucaugugggccugccagaagggaaacauucgcuguaauaucugcauuuga

SEQ ID NO: 184239 - RNA, 1701 nt, Artificial Sequence; identical to SEQ ID NO: 184077
  derived and/or modified sequence opt5 from hemagglutinin__InfluenzaA__ABI21343

SEQ ID NO: 184240 - RNA, 1701 nt, Artificial Sequence
  derived and/or modified sequence opt5 from hemagglutinin__InfluenzaA__ABI21354
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacaaggagugggaucuguucgucgaacgcuccaaagccuauucuaauuguuacccuuaugacgugcccgauuacgcuagccucagaucccugguugccagcucugggacgcuugaguuuauuaacgaagacuucaauuggaccggaguggcucaggauggcaaguccuaugccugcaagcggggcagcgucaacucuuucuucucccgccugaauuggcuccacaaacuggaguacaaguauccugcgcuuaacgugacaaugcccaauaacgggaaauuugacaagcuguacaucuggggaguucaucacccuagcaccgauucugaccaaacaucccucuacgugagagccagcggccgggucaccguguccacgaaacgcucucagcagacagugauuccgaauaucgggagcagacccuggguccggggacuguccagccgcauuucuaucuauuggaccauuguuaagccuggcgacauccugcucaucaacuccacagggaaccugauugcucccagaggauacuucaagauccggaauggcaaaagcucuauuaugcgcagcgaugccccuaucggcaacuguuccucugagugcauuacccccaaugggagcaucccgaacgacaagccuuuucagaaugugaacagaaucaccuauggagcuuguccccgguacgugaaacaaaauacacuuaagcuggccacgggcaugcgcaacgucccugaaaaacagaccagagggauuuucggagcgaucgccggcuuuauugagaaugggugggaaggaaugguggauggcugguauggcuuccggcaccagaacuccgaggggacaggacaggcugccgaccucaagagcacccaagcugccaucgaucagauuaauggcaaacugaacagacuuaucgagaagacaaaugaaaaguuucaucagaucgagaaagaauuuucugagguugaagggcgcauucaagaccuggagaaguacguggaggauaccaaaaucgaccucugguccuauaacgccgaacugcuggucgcucucgagaaucagcacacgauugaucugacagacagcgaaaugaacaaacuuuucgagcggaccagaaagcagcugcgcgaaaacgcggaggauaugggaaauggcugcuuuaagaucuaccauaagugugacaacgccugcauugggucuauccggaauggcaccuacgaccacgauguguauagagacgaggcucucaacaaucgcuuccagauuaaaggaguugaacugaaguccggcuacaaagauuggauccuuuggaucagcuuugccauuuccugcuuccugcucugugugguccugcugggguuuaucaugugggccugccaaaagggaaacauucgguguaauaucugcauuuga

SEQ ID NO: 184241 - RNA, 1701 nt, Artificial Sequence
  derived and/or modified sequence opt5 from hemagglutinin__InfluenzaA__ABI21365
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagcugccaucgaucagauuaauggcaaacuuaacagacugaucgagaagacaaaugaaaaguuucaucagaucgagaaagaguucagcgaaguugaagggcgcauucaagaccucgagaaguacguggaggauaccaaaaucgaccuguggucuuauaacgccgaacugcucgucgcucuggagaaucagcacacgauugaucuuacagacuccgaaauggauaagcuguucgagcggaccagaaaacagcuccgcgaaaacgcggaggacaugggaaacggcugcuuuaagaucuaccauaagugugacaaugccugcauugggagcauccggaacggcaccuacgaucacgacguguauagagaugaggcucugaauaaccgcuuccagauuaaaggaguugaacuuaagucuggcuacaaagacuggauccuguggaucuccuuugccauuagcugcuuccuccugugugugguccugcucggguuuaucaugugggccugccaaaagggaaauauucgguguaacaucugcauuuga

SEQ ID NO: 184242 - RNA, 1701 nt, Artificial Sequence
  derived and/or modified sequence opt5 from hemagglutinin__InfluenzaA__ABI21376
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuauuccugcaagcggggcagcgucaacucuuucuucucccgccucaauuggcugcacaaacuugaguacaaguauccugcccugaacgugacaaugcccaauaacgacaaauuugauaagcucuacaucuggggaguucaucacccuagcaccgacucugaccaaacaucccuguacgugagagcgagcgggcgggucaccguguccacgaaacgcucucagcagacagugauuccgaauaucggcagcagacccuggguccgggggcuguccagccgcauuucuaucuauuggaccauuguuaagccuggagauauccuccugaucaacuccacaggcaaccuuauugcccccagaggguacuucaagauccggaauggaaaaagcucuauuaugcgcagcgacgcuccuaucggcaacuguuccucugagugcauuacccccaauggcagcaucccgaacgauaagccuuuucagaaugugaacagaaucaccuauggggccuguccccgguacgugaaacaaaauacacugaagcucgcuacgggaaugcgcaacgucccugaaaaacagaccagaggcauuuucggggccaucgcgggauuuauugagaauggcugggaagggaugguggacggaugguauggcuuccggcaccagaacuccgagggcacagggcaggccgcugaucuuaagagcacccaagccgcuaucgaccagauuaauggaaaacugaacagacugaucgagaagacaaaugaaaaguuucaucagaucgagaaagaauuuucugagguugaaggccgcauucaagaucucgagaaguacguggaggacaccaaaaucgaucugugguccuauaacgccgaacugcucgucgcccuggagaaucagcacacgauugaccuuacagauagcgaaaugaacaagcuguucgagcggaccagaaaacagcuccgcgaaaacgcugaggacauggggaauggaugcuuuaagaucuaccauaagugugacaacgcgugcauuggcucuauccggaaugggaccuacgaucacgacguguauagagaugaggcccugaacaaucgcuuccagauuaaaggcguugaacuuaaguccggauacaaagacuggauccuguggaucagcuuugcuauuuccugcuuccuccugugugugguccugcucggcuuuaucaugugggccugccaaaaggggaacauucgguguaauaucugcauuuga

SEQ ID NO: 184243 - RNA, 1701 nt, Artificial Sequence; identical to SEQ ID NO: 184077
  derived and/or modified sequence opt5 from hemagglutinin__InfluenzaA__ABI21387

SEQ ID NO: 184244 - RNA, 1701 nt, Artificial Sequence
  derived and/or modified sequence opt5 from hemagglutinin__InfluenzaA__ABI21398
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuugugaacgaagacuucaauuggaccggagucgcucaggauggcaagucuuaugccugcaagcggggcuccgugaacagcuuuuucucucgccucaauuggcugcacaaacuugaguacaaguauccugcgcugaacguuacaaugcccaauaacgggaaauuugacaagcucuacauuuggggagugcaucacccuuccaccgauagcgaccaaacaucucuguacgucagagccuccggccgggugaccgugagcacgaaacgcucccagcagacagucaucccgaauauugggucuagacccuggguucggggacugagcucccgcaucagcauuuauuggaccaucgugaagccuggcgacauucuccugaucaacucuacagggaaccuuaucgcucccagaggauacuucaagauucggaauggcaaauccagcaucaugcgcucugaugccccuauuggcaacuguagcuccgagugcaucacccccaaugggucuauuccgaacgacaagccuuuucagaaugugaacagaaucaccuauggagcuuguccccgguacgucaaacaaaauacacugaagcucgccacgggcaugcgcaacgugccugaaaaacagaccagagggaucuucggagcgauugccggcuuuaucgagaaugggugggaaggaaugguugauggcugguauggcuuccggcaccagaacagcgaggggacaggacaggcugccgaccugaaguccacccaagcugccauugaucagaucaauggcaaacuuaacagacugauugagaagacaaaugaaaaguuucaucagaucgagaaagaguucagcgaaguggaagggcgcauccaagaccucgagaaguacgucgaggauaccaaaauugaccuguggucuuauaacgccgaacugcucguggcucuggagaaucagcacacgaucgaucuuacagacuccgaaaugaacaagcuguucgagcggaccagaaaacagcuccgcgaaaacgcggaggauaugggaaauggcugcuuuaagauuuaccauaagugugacaacgccugcaucgggagcauucggaauggcaccuacgaccacgauguuuauagagacgaggcucugaacaaucgcuuccagaucaaaggaguggaacuuaagucuggcuacaaagauuggauucuguggaucuccuuugccaucagcugcuuccuccugugugucgugcugcucggguuuauuaugugggccugccaaaagggaaacauccgguguaauauuugcaucuga

SEQ ID NO: 184245 - RNA, 1701 nt, Artificial Sequence; identical to SEQ ID NO: 184077
  derived and/or modified sequence opt5 from hemagglutinin__InfluenzaA__ABI21409

SEQ ID NO: 184246 - RNA, 1701 nt, Artificial Sequence
  derived and/or modified sequence opt5 from hemagglutinin__InfluenzaA__ABI21420
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcagaauuugcgacucuccgcaccggauccuggaugggaaaaauuguacgcucaucgacgcucugcugggagauccccauugcgacggcuuucagaacaaggagugggaucucuucgucgaacgcagcaaagccuauuccaauuguuacccuuaugacgugcccgauuacgccucucugagaagccuuguugcuuccagcgggacccuggaguuuauuaacgaagacuucaauuggacaggaguggcccaggauggcggcucuuauuccugcaagcgggggagcgucaacucuuucuucucccgccucaauuggcugcacaaacuugaguacaaguauccugcucugaacgugaccaugcccaauaacggaaaguuugacaaacucuacaucuggggcguucaucacccuagcacagauucugaccaaaccucccuguacgugagagccagcgggcgggucacgguguccacaaagcgcucucagcagaccgugauuccgaauaucggaagcagacccuggguccggggccuguccagccgcauuucuaucuauuggacaauuguuaaaccuggggacauccuccugaucaacuccaccggaaaccuuauugcgcccagaggcuacuucaagauccggaauggcaagagcucuauuaugcgcagcgaugccccuaucgggaacuguuccucugagugcauuacccccaauggaagcaucccgaacgacaaaccuuuucagaaugugaacagaaucacauauggcgcuuguccccgguacgugaagcaaaauacgcugaaacucgccaccgggaugcgcaacgucccugaaaagcagacaagaggaauuuucggcgcuaucgccggguuuauugagaauggaugggaaggcaugguggauggcugguauggguuccggcaccagaacuccgagggaaccggccaggcggccgaccugaaaagcacacaagcugccaucgaucagauuaaugggaaacuuaacagacugaucgagaagaccaaugaaaaguuucaucagaucgagaaggaauuuucugagguugaaggacgcauucaagaccucgagaaauacguggaggauacgaagaucgaccugugguccuauaacgcugaacugcucgucgcccuggagaaucagcacacaauugaucuuaccgacagcgaaaugaacaaacuguucgagcggaccagaaagcagcuccgcgaaaacgccgaggauaugggcaaugggugcuuuaaaaucuaccauaagugugacaacgcuugcauuggcucuauccggaauggaacauacgaccacgauguguauagagacgaggcgcugaacaaucgcuuccagauuaaguccguugaacuuaaaagcggcuacaaggauuggauccuguggaucuccuuugccauuucuugcuuccuccugugugugguccugcucggguuuaucaugugggcuugccaaaaaggaaacauucgguguaauaucugcauuuga

SEQ ID NO: 184247 - RNA, 1701 nt, Artificial Sequence; identical to SEQ ID NO: 184077
  derived and/or modified sequence opt5 from hemagglutinin__InfluenzaA__ABI21431

SEQ ID NO: 184248 - RNA, 1701 nt, Artificial Sequence; identical to SEQ ID NO: 184077
  derived and/or modified sequence opt5 from hemagglutinin__InfluenzaA__ABI21442

SEQ ID NO: 184249 - RNA, 1701 nt, Artificial Sequence; identical to SEQ ID NO: 184077
  derived and/or modified sequence opt5 from hemagglutinin__InfluenzaA__ABI21453

SEQ ID NO: 184250 - RNA, 1701 nt, Artificial Sequence; identical to SEQ ID NO: 184077
  derived and/or modified sequence opt5 from hemagglutinin__InfluenzaA__ABI21464

SEQ ID NO: 184251 - RNA, 1701 nt, Artificial Sequence; identical to SEQ ID NO: 184077
  derived and/or modified sequence opt5 from hemagglutinin__InfluenzaA__ABI21475

SEQ ID NO: 184252 - RNA, 1701 nt, Artificial Sequence
  derived and/or modified sequence opt5 from hemagglutinin__InfluenzaA__ABI21486
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggccgggucaccgugagcacgaaacgcucccagcagacagugauuccgaauaucgggucuagacccuggguccggggacugagcucccgcauuagcaucuauuggaccauuguuaagccuggcgacauccuccugaucaacucuacagggaaccuuauugcucccagaggauacuucaagauccggaauggcaaauccagcauuaugcgcucugaugccccuaucggcaacuguagcuccgagugcauuacccccaaugggucuaucccgaacgacaagccuuuucagaaugugaacagaaucaccuauggagcuuguccccgguacgugaaacaaaauacacugaagcucgccacgggcaugcgcaacgucccugaaaaacagaccagagggauuuucggagcgaucgccggcuuuauugagaaugggugggaaggaaugguggauggcugguauggcuuccggcaccagaacagcgaggggacaggacaggcugccgaccugaaguccacccaagaggcuaucgaucagauuaauggcaaacuuaacagacugaucgaaaagacaaaugagaaguuucaucagaucgaaaaagaguucagcgaaguugaggggcgcauucaagaccucgagaaguacguggaagauaccaaaaucgaccuguggucuuauaacgccgagcugcucgucgcccuggaaaaucagcacacgauugaucuuacagacuccgagaugaacaagcuguucgaacggaccagaaaacagcuccgcgagaacgcugaggauaugggaaauggcugcuuuaagaucuaccauaagugugacaacgcgugcauugggagcauccggaauggcaccuacgaccacgauguguauagagacgaagcccugaacaaucgcuuccagauuaaaggaguugagcuuaagucuggcuacaaagauuggauccuguggaucuccuuugcuauuagcugcuuccuccugugugugguccugcucggguuuaucaugugggccugccaaaagggaaacauucgguguaauaucugcauuuga

SEQ ID NO: 184253 - RNA, 1701 nt, Artificial Sequence; identical to SEQ ID NO: 184077
  derived and/or modified sequence opt5 from hemagglutinin__InfluenzaA__ABI21497

SEQ ID NO: 184254 - RNA, 1698 nt, Artificial Sequence
  derived and/or modified sequence opt5 from hemagglutinin__InfluenzaA__ABI21530
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggugcagagagccauuuaccggacagagaacgcuuaugucucuguugugagcucccacuacagccgcagauucaccccggaaaucgccaaacggcccaaggugcgcgaucaggagggcagaauuaauuauuacuggacgcuccuggagccuggggacacaaucauuuuugaagcgaacggaaaucuuaucgcccccugguaugcuuucgcccugucucggggcuuugaguccgggauuaucaccagcaacgcuccuaugaaugaaugugaugccaagugccagacaccccaaggagcgaucaacucuagccucccguuccagaauguccauccugugaccauuggcgagugucccaaauacguucgcuccgccaagcugagaauggugaccggccuucggaacaucccuucuauucagagccgcgggcuguuuggagcuaucgccggcuucauugaagggggauggacaggcaugaucgacgggugguauggauaccaccaucagaaugagcaaggcuccggcuacgcugccgaucagaaaagcacgcagaacgccaucaaugggauuaccaacaaggucaauucugugaucgagaaaaugaacacacaguuuaccgcuguuggaaaggaguucaauaaacucgaaagacggauggaaaaccugaacaagaagguggacgauggcuuccuggacauuuggacauauaaugcggagcuccugguccuucuggaaaacgagcgcacccucgauuuucacgacuccaaugugaaaaaccuguacgagaaggucaaaagccaacuuaagaauaacgccaaagaaaucgggaauggaugcuucgaguuuuaucacaaguguaacaaugaaugcauggagucugugaagaacggcacguacgacuaucccaaauacuccgaggaaagcaagcugaauagagagaaaauugaugggguuaagcucgaauccaugggcguguaucagauccuggcuaucuacucuacagucgccagcucccuggugcuccugguuucucuuggagccauuagcuucuggaugugcuccaacggcagccugcagugucggaucugcauuuga

SEQ ID NO: 184255 - RNA, 1698 nt, Artificial Sequence
  derived and/or modified sequence opt5 from hemagglutinin__InfluenzaA__ABI21552
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggugcagagagccauuuaccacacagagaacgcuuaugucucuguugugagcucccauuacagccggcgcuucaccccggaaaucgccaaaagacccaaggugcgggaucaggagggccgcauuaauuauuacuggacgcuccuggagccuggggacacaaucauuuuugaagcgaacggaaaucuuaucgcccccugguaugcuuucgcccugucuagaggcuuugaguccgggauuaucaccagcaacgcuccuauggaugaaugugacgccaagugccagacaccccaaggagcgaucaauucuagccucccguuccagaacguccacccugugaccauuggcgagugucccaaauacguucgguccgccaagcugcgcauggugaccggccuuagaaauaucccuucuauucagagccgggggcuguuuggagcuaucgccggcuucauugaagggggauggacaggcaugaucgaugggugguauggauaccaucaccagaacgagcaaggcuccggcuacgcugccgaccagaaaagcacgcagaaugccaucaacgggauuaccaauaaggucaacucugugaucgagaaaaugaauacacaguuuaccgcuguuggaaaggaguucaacaaacucgaacgcagaauggaaaaucugaacaagaagguggaugacggcuuccuggauauuuggacauauaacgcggagcuccugguccuucuggaaaaugagcggacccucgacuuucacgacuccaacgugaaaaaucuguacgagaaggucaaaagccaacuuaagaacaaugccaaagaaaucgggaacggaugcuucgaguuuuaucauaaguguaauaacgaaugcauggagucugugaagaauggcacguacgauuaucccaaauacuccgaggaaagcaagcugaaccgcgagaaaauugacgggguuaagcucgaauccaugggcguguaucagauccuggcuaucuacucuacagucgccagcucccuggugcuccugguuucucuuggagccauuagcuucuggaugugcuccaauggcagccugcaguguagaaucugcauuuga

SEQ ID NO: 184256 - RNA, 1698 nt, Artificial Sequence
  derived and/or modified sequence opt5 from hemagglutinin__InfluenzaA__ABI21563
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggugcagagagccauuuaccacacagagaacgcuuaugucucuguugugagcucccauuacagccggcgcuucaccccggaaaucgccaaaagacccaaggugcggggccaggaggggcgcauuaauuauuacuggacgcuccuggagccuggagauacaaucauuuuugaagcgaacggcaaucuuaucgcccccugguaugcuuucgcccugucuagaggguuugaguccggaauuaucaccagcaacgcuccuaugaaugaaugugacgccaagugccagacaccccaaggcgcgaucaacucuagccucccguuccagaauguccacccugugaccauuggcgagugucccaaauacguucgguccgccaagcugcgcauggugaccgggcuuagaaacaucccuucuauucagagccggggacuguuuggcgcuaucgccggguucauugaaggaggcuggacagggaugaucgauggaugguauggcuaccaucaccagaaugagcaaggcuccggguacgcugccgaccagaaaagcacgcagaacgccaucaauggaauuaccaacaaggucaauucugugaucgagaaaaugaacacacaguuuaccgcuguuggcaaggaguucaauaaacucgaacgcagaauggaaaaccugaacaagaagguggaugacggguuccuggauauuuggacauauaaugcggagcuccugguccuucuggaaaacgagcggacccucgacuuucacgauuccaaugugaaaaaccuguacgagaaggucaaaagccaacuuaagaauaacgccaaagaaaucggaaauggcugcuucgaguuuuaucauaaguguaacaaugaaugcauggagucugugaagaacgggacguacgacuaucccaaauacuccgaggaaagcaagcugaaucgcgagaaaauugacggcguuaagcucgaauccaugggaguguaucagauccuggcuaucuacucuacagucgccagcucccuggugcuccugguuucucuuggcgccauuagcuucuggaugugcuccaacgggagccugcaguguagaaucugcauuuga

SEQ ID NO: 184257 - RNA, 1698 nt, Artificial Sequence; identical to SEQ ID NO: 184256
  derived and/or modified sequence opt5 from hemagglutinin__InfluenzaA__ABI21574

SEQ ID NO: 184258 - RNA, 1701 nt, Artificial Sequence
  derived and/or modified sequence opt5 from hemagglutinin__InfluenzaA__ABI21736
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugcgcgagaacgccgaggacgucgggaauggauguuuuaagaucuaucauaaaugcgauaacgcuugcauuggcucuauccggaaugggaccuacgaccacgauguguacagagacgaagcccucaacaaucgcuuccagauuaagggcguugagcugaaauccggauauaaggacuggauccuuuggaucagcuuugccauuuccuguuuccugcucugcgugguccugcugggcuuuaucaugugggcuugucagaaagggaacauucggugcaauaucuguauuuga

SEQ ID NO: 184259 - RNA, 1701 nt, Artificial Sequence
  derived and/or modified sequence opt5 from hemagglutinin__InfluenzaA__ABI22159
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaugccuauuccaacuguuacccuuaugacgugcccgauuacgcuucucuccggagccugguugccuccagcgggacgcuugaauuuaauaacgagucuuucaauuggaccggagugacacagaacggcaccuccagcgcuugcaaacgcagaucuaauaacuccuuuuucagccggcugaauuggcucacacaucugaaguuuaaguauccugcccuuaacgucaccaugcccaacaaugagaaauucgacaagcuguacaucuggggcgugcaccauccugggacggauaacgaccagauuuuucucuaugcgcaggccucuggacgcaucacaguuuccaccaaaagaagccaacagacagugauuccgaauaucggcucccggccccgcgucagaaacauuccuucucggaucagcaucuacuggaccauugugaagcccggggauauccugcugauuaauuccaccggaaaccucaucgcuccucgcggcuacuucaaaauuagaagcgggaagucuuccaucaugcggagcgacgcccccaucggaaaguguaauucugaaugcauuacaccgaacggcagcaucccuaaugacaaacccuuucagaacgugaaucgcauuacguauggcgcuuguccuagauacgucaagcagaacacccugaaacuugccacagggaugcggaauguucccgagaagcaaacccgcggaaucuucggcgcgauugccggguuuaucgaaaacggaugggagggcaugguggaugggugguauggauucagacaccaaaauuccgagggcaucggccaggcugccgaccugaaaucuacacaggcugccauuaaccagaucaacgggaagcucaaucggcugauuggaaaaaccaacgaaaaguuccaccagaucgagaaggaauuuagcgagguggaaggccgcauucaggaucuugagaaauacgucgaggacacgaagaucgaucugugguccuauaaugccgaacuccugguggcucuggagaaccaacauacaauugaccucaccgauagcgaaaugaauaaacuguucgagagaaccaagaaacagcuucgggaaaacgcggaggacauggggaauggaugcuuuaagaucuaccacaagugugauaacgccugcaucggcucuauuagaaaugggacauaugaccaugauguuuaccgcgacgaggcucugaacaaucgguuccagaucaaaggcguggaacucaaguccggauacaaagacuggauucuguggaucagcuuugccauuucuugcuuccuucugugugucgcccuccugggcuuuaucaugugggcuugccagaaggggaacaucagauguaauauuugcaucuga

SEQ ID NO: 184260 - RNA, 1707 nt, Artificial Sequence
  derived and/or modified sequence opt5 from hemagglutinin__InfluenzaA__ABI23979
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggaaaagacacacaaugggaaacucugugaucuggacggagucaaaccccuuauccugagagauugcagcguggcgggcuggcuccuggggaacccuaugugugacgaguuccugaauguuccggaaugguccuauauuguggagaagaucaaccccgcuaaugaucucugcuacccuggaaacuuuaaugacuaugaggaacugaagcaucuucugucucggauuaaccacuucgagaaaauccagauuauccccaagagcuccuggucugaucaugaagccagcuccggcgucagcucugccuguccuuaccaggggcgcuccagcuuuuucagaaaugugguuuggcucauuaaaaaggacaacgcuuaucccaccaucaaacggucuuacaauaacacaaaucaagaggaucugcuugugcuguggggaauccaccacccuaacgacgccgcugagcagacccgccucuaucagaacccgacaaccuacauuuccgucggcacgagcacccugaaucagagacuggugcccaagaucgccacacggucuaaggugaacggccaauccgggcgcauggaauuuuucuggaccauucucaaaccuaaugaugcgaucaacuuugagagcaauggaaacuucauugcccccgaaaaugcuuacaagaucgucaaaaagggcgacuccacaaucaugaaaucugagcuggaauaugggaacugcaauaccaagugucagacgccuauuggagccaucaacagcuccaugcccuuucauaauauucacccgcuuacaaucggcgagugcccuaaauacguuaagagcaacagacuggugcucgcuaccgggcugcgcaauucuccccagggagagcggagacggaagaaacgcggccuuuucggcgccauugcgggguuuaucgaaggaggcuggcaggggaugguggacggaugguauggcuaccaucacuccaacgagcaagggagcggauaugccgcugauaaggaaucuacacagaaagccaucgacggcgucaccaauaaggugaacagcauuaucgauaaaaugaacacccaguucgaggcuguuggcagagaauuuaauaaccuggagcggcgcauugagaaucucaacaagaagauggaagacggguuccuggauguguggacauacaaugccgagcugcucguccugauggaaaacgagagaacgcuugacuuccacgauuccaaugugaaaaaccuguaugacaagguucggcuccaacugagagauaaugccaaagaacuuggaaacggcuguuuugaguucuaccaucgcugcgacaaugaguguauggaaucugugcggaacgggaccuacgauuauccucaguacagcgaggaauccagacugaagcgcgaggagaucagcggagucaaacucgaaucuauuggcacauaucagauccuguccauuuacagcaccguggcuucuucccuggcgcucgccaucauggucgcugggcugagccuuuggaugugcuccaauggcucucugcagugccggaucuguauuuga

SEQ ID NO: 184261 - RNA, 1701 nt, Artificial Sequence; identical to SEQ ID NO: 183306
  derived and/or modified sequence opt5 from hemagglutinin__InfluenzaA__ABI26646

SEQ ID NO: 184262 - RNA, 1701 nt, Artificial Sequence; identical to SEQ ID NO: 183935
  derived and/or modified sequence opt5 from hemagglutinin__InfluenzaA__ABI30367

SEQ ID NO: 184263 - RNA, 1701 nt, Artificial Sequence; identical to SEQ ID NO: 183945
  derived and/or modified sequence opt5 from hemagglutinin__InfluenzaA__ABI30378

SEQ ID NO: 184264 - RNA, 1701 nt, Artificial Sequence; identical to SEQ ID NO: 183674
  derived and/or modified sequence opt5 from hemagglutinin__InfluenzaA__ABI30400

SEQ ID NO: 184265 - RNA, 1701 nt, Artificial Sequence
  derived and/or modified sequence opt5 from hemagglutinin__InfluenzaA__ABI30411
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagauggacaaacuuuucgaaagaaccaagaagcagcugcgcgagaaugccgaggauauggggaacggauguuuuaagaucuaucauaaaugcgacaaugcuugcauuggcucuauccggaacgggaccuacgaucacgacgucuacagagacgaagcccucaauaaccgcuuccagauuaagggcguggagcugaaauccggauauaaggauuggauccuuuggaucagcuuugccauuuccuguuuccugcucugcguugugcugcugggcuuuaucaugugggcuugucagaaagggaauauucggugcaacaucuguauuuga

SEQ ID NO: 184266 - RNA, 1701 nt, Artificial Sequence; identical to SEQ ID NO: 183615
  derived and/or modified sequence opt5 from hemagglutinin__InfluenzaA__ABI30422

SEQ ID NO: 184267 - RNA, 1701 nt, Artificial Sequence; identical to SEQ ID NO: 183306
  derived and/or modified sequence opt5 from hemagglutinin__InfluenzaA__ABI30433

SEQ ID NO: 184268 - RNA, 1701 nt, Artificial Sequence; identical to SEQ ID NO: 183615
  derived and/or modified sequence opt5 from hemagglutinin__InfluenzaA__ABI30444

SEQ ID NO: 184269 - RNA, 1701 nt, Artificial Sequence; identical to SEQ ID NO: 183306
  derived and/or modified sequence opt5 from hemagglutinin__InfluenzaA__ABI30455

SEQ ID NO: 184270 - RNA, 1701 nt, Artificial Sequence; identical to SEQ ID NO: 183306
  derived and/or modified sequence opt5 from hemagglutinin__InfluenzaA__ABI30466

SEQ ID NO: 184271 - RNA, 1701 nt, Artificial Sequence; identical to SEQ ID NO: 183306
  derived and/or modified sequence opt5 from hemagglutinin__InfluenzaA__ABI30477

SEQ ID NO: 184272 - RNA, 1701 nt, Artificial Sequence; identical to SEQ ID NO: 183306
  derived and/or modified sequence opt5 from hemagglutinin__InfluenzaA__ABI30488

SEQ ID NO: 184273 - RNA, 1701 nt, Artificial Sequence; identical to SEQ ID NO: 183306
  derived and/or modified sequence opt5 from hemagglutinin__InfluenzaA__ABI30499

SEQ ID NO: 184274 - RNA, 1701 nt, Artificial Sequence; identical to SEQ ID NO: 183267
  derived and/or modified sequence opt5 from hemagglutinin__InfluenzaA__ABI30510

SEQ ID NO: 184275 - RNA, 1701 nt, Artificial Sequence
  derived and/or modified sequence opt5 from hemagglutinin__InfluenzaA__ABI30521
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuucucucuaugcgcaggccuccggccgcaucacaguuagcaccaagagaucccaacagacagugauuccgaauaucgggucucggccccgcgucagagacauuccuagccggaucuccaucuacuggaccauugugaaacccggagauauccugcugauuaacagcaccggcaaucucaucgcuccucgcggguacuuuaagauuagaucuggaaaguccagcaucaugcggucugacgccagcaucggcaaauguaacuccgagugcauuacacccaauggcucuaucccgaacgacaagccuuuccagaaugugaaccgcauuacguauggggcuugucccagauacgucaaacagaauacccugaaacuugccacaggaaugcggaacguuccugaaaagcaaacccgcggcaucuuuggggcgauugccggauucaucgagaauggcugggaagggaugguggauggaugguauggcuuuagacaccagaacagcgagggcaucgggcaggcugccgaccugaaguccacacaagcugccauuaaucagaucaacggaaaacucaaccggcugauuggcaagaccaaugagaaguuccaccagaucgaaaaagaguucagcgaaguggaggggcgcauucaggaucuugaaaaguacgucgaggacacgaaaaucgaucuguggucuuauaacgccgagcuccugguggcucuggaaaaucaacauacaauugaccucaccgauuccgagaugaacaagcuguuugaaagaaccaaaaagcagcuucgggagaaugcggaagacaugggaaacggcugcuucaagaucuaccacaaaugugauaaugccugcaucgggagcauuagaaacggcacauaugaccaugauguuuaccgcgacgaggcucugaauaaccgguuucagaucaagggaguggagcucaaaucuggcuacaaggacuggauucuguggaucuccuucgccauuagcugcuuucuucugugugucgcccuccugggguucaucaugugggcuugccagaaaggaaauaucagauguaacauuugcaucuga

SEQ ID NO: 184276 - RNA, 1701 nt, Artificial Sequence; identical to SEQ ID NO: 183306
  derived and/or modified sequence opt5 from hemagglutinin__InfluenzaA__ABI30532

SEQ ID NO: 184277 - RNA, 1701 nt, Artificial Sequence; identical to SEQ ID NO: 184137
  derived and/or modified sequence opt5 from hemagglutinin__InfluenzaA__ABI30543

SEQ ID NO: 184278 - RNA, 1701 nt, Artificial Sequence; identical to SEQ ID NO: 183306
  derived and/or modified sequence opt5 from hemagglutinin__InfluenzaA__ABI30554

SEQ ID NO: 184279 - RNA, 1698 nt, Artificial Sequence; identical to SEQ ID NO: 184228
  derived and/or modified sequence opt5 from hemagglutinin__InfluenzaA__ABI30565

SEQ ID NO: 184280 - RNA, 1701 nt, Artificial Sequence; identical to SEQ ID NO: 183657
  derived and/or modified sequence opt5 from hemagglutinin__InfluenzaA__ABI30587

SEQ ID NO: 184281 - RNA, 1701 nt, Artificial Sequence
  derived and/or modified sequence opt5 from hemagglutinin__InfluenzaA__ABI30609
augaagaccaucauugcccugagcuacauccucugccugguguucgcucagaaacuucccggcaacgacaauuccacagccacgcugugucucgggcaccaugcggucccuaacggaaccauuguuaagacaaucaugaaugaucaaauugaggugaccaacgcuacagaacuggugcagucuagcuccaccggcgggaucugcgacucuccgcaccagauccuugauggagagaauuguacacugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacccuugaguuuaacaaugaaucuuucaacuggacgggcgugacccagaauggcacauccagcgcuugcaagcgcagaucuaacaauuccuuuuucagccggcugaacuggcucacccaucugaaguuuaaauauccugcccuuaaugucacaaugcccaacaacgagaaguucgacaaacuguacaucuggggagugcaccauccugggaccgauaaugaccagauuuuucucuaugcgcaggccucuggccgcaucacgguuuccacaaagagaagccaacagaccgugauuccgaacaucgggucccggccccgcgucagaaauauuccuucucggaucagcaucuacuggacaauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuaccccgaauggcagcaucccuaacgacaagcccuuucagaaugugaaccgcauuacauauggggcuuguccuagauacgucaaacagaauacgcugaaacuugccaccggaaugcggaacguucccgaaaagcaaacacgcggcaucuucggggcgauugccggauuuaucgagaauggcugggaagggaugguggauggaugguauggcuucagacaccagaacuccgagggcaccgggcaggcugccgaccugaagucuacacaagcugccaucaaucagauuaacggaaaacucaaccggcugaucggcaagaccaaugagaaguuccaccagauugaaaaagaguuuagcgaaguggaggggagaauccaggaucuugaaaaguacgucgaggacacgaaaauugaucugugguccuauaacgccgagcuccugguggcucuggaaaaucaacauacaaucgaccucaccgauagcgagaugaacaagcuguucgaacgcaccaaaaagcagcuucgggagaaugcggaagacaugggaaacggcugcuuuaagauuuaccacaaaugugauaaugccugcaucgggucuaucagaaacggcacauaugaccaugauguuuaccgcgacgaggcucugaauaaccgguuccagauuaagggaguggagcucaaauccggcuacaaggacuggauccuguggauuagcuuugccaucucuugcuuccuucugugugucgcccuccugggguuuauuaugugggcuugccagaaaggaaauaucagauguaacaucugcauuuga

SEQ ID NO: 184282 - RNA, 1701 nt, Artificial Sequence
  derived and/or modified sequence opt5 from hemagglutinin__InfluenzaA__ABI30620
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucaucgaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucccuagccggaucuccauuuacuggaccaucgucaaacccggagacauucugcugaucaauagcaccggcaaccucauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgugaaacagaacacccugaagcuggccacaggaaugcggaauguccccgaaaaacaaacccgcggcauuuuuggggcgaucgccggauucaucgagaacggcugggaagggaugguugacggaugguauggcuuuagacaccaaaauucugagggcauugggcaggcugccgaucuuaagagcacacaggcugccaucaaccagauuaauggaaaacucaaccggcugaucggcaagaccaacgagaaguuccaccagauugaaaaagaguucuccgaaguggaggggagaauccaggaccuugaaaaguacguggaggauacgaaagucgaccuguggagcuauaaugccgagcuccugguggcucuggaaaaccaacauacaauugaucucaccgacucugagaugaauaagcuguuugaacgcaccaaaaagcagcuucgggagaacgcggaagauaugggaaauggcugcuucaagaucuaccacaaaugugacaacgccugcaucggguccauuagaaauggcacauaugaucaugacguuuaccgcgacgaggcucugaacaaucgguuucagaucaagggaguggagcucaaaagcggcuacaaggauuggauucuguggaucucuuucgccauuuccugcuuucuucugugugucgcccuccugggguucaucaugugggcuugccagaaaggaaacaucagauguaauauuugcaucuga

SEQ ID NO: 184283 - RNA, 1701 nt, Artificial Sequence; identical to SEQ ID NO: 183657
  derived and/or modified sequence opt5 from hemagglutinin__InfluenzaA__ABI30733

SEQ ID NO: 184284 - RNA, 1701 nt, Artificial Sequence; identical to SEQ ID NO: 183657
  derived and/or modified sequence opt5 from hemagglutinin__InfluenzaA__ABI30744

SEQ ID NO: 184285 - RNA, 1701 nt, Artificial Sequence; identical to SEQ ID NO: 183657
  derived and/or modified sequence opt5 from hemagglutinin__InfluenzaA__ABI30755

SEQ ID NO: 184286 - RNA, 1701 nt, Artificial Sequence; identical to SEQ ID NO: 183657
  derived and/or modified sequence opt5 from hemagglutinin__InfluenzaA__ABI30766

SEQ ID NO: 184287 - RNA, 1701 nt, Artificial Sequence; identical to SEQ ID NO: 183657
  derived and/or modified sequence opt5 from hemagglutinin__InfluenzaA__ABI30777

SEQ ID NO: 184288 - RNA, 1701 nt, Artificial Sequence
  derived and/or modified sequence opt5 from hemagglutinin__InfluenzaA__ABI30788
augaagaccaucauugcccugagcuacauccucugccugguguucgcucagaaacuuuccggcaacgacaauucuacagccacgcugugucucgggcaccaugcgguccccaacggaaccauuguuaagacaaucaccaaugaucaaauugaggugacaaacgcuaccgaacuggugcagagcuccucuacaggcgggaucugcgacagcccucaccagauccuugauggagagaauuguacccugauugacgcccuccugggcgauccgcagugcgacggguuucaaaacaaaaagugggaucuguucgucgaaagauccaaagccuauucuaauuguuaccccuaugacgugccugauuacgcuagccuccggucccugaucgccagcucuggaacgcuugaguuuaacaaugaauccuucaacuggaccggcguuacacagaauggcaccagcucugcuugcaagcgcagauccaacagcucuuucuucucccggcugaauuggcucacacaucugaaguuuaaauaucccgcccuuaacgugaccaugccuaauaacgaggaguucgacaagcuguacauuuggggaguccaccaucccgggacguauaacgaucagaucagccucuacgcgcaggccuccggccgcauuacagugucuaccaaaagaagccaacagacaguuaucccuaauauugggucccggccgcgcgugagagacauccccagccggaucucuauuuacuggaccaucgucaagccuggagauauucugcugaucaacuccaccggcaaucucauugcuccccgcggguauuuuaaaaucagaagcggaaagucuagcaucaugcgguccgacgccccuauuggcaaguguaacucugaaugcaucacacccaauggcagcauuccgaacgacaaaccuuuccagaaugugaaccgcaucacguacggggcuugucccagauaugugaagcagaauacccugaaacuugccacaggaaugcggaacgucccugagaagcaaacccgcggcauuuuuggggcgaucgccggauucaucgaaaauggcugggaggggaugguugauggaugguacggcuuuagacaccagaacuccgagggcauugggcaggcugccgaccugaaaagcacacaagcugccaucgaucagauuaauggaaagcucaaccggcugaucggcaaaaccaaugaaaaguuccaccagauugagaaggaauuuucugagguggaagggagaauccaggaccuugagaaauauguggaggauacgaagauugaccugugguccuacaacgccgaacuccuggucgcucuggagaaccaacauacaaucgaucucaccgacagcgaaaugaauaaacuguuugagcgcaccaagaaacagcuucgggaaaacgcggaggauaugggaaauggcugcuucaagaucuaucacaagugugacaacgccugcauugggucuaucagaaauggcacauacgaucaugacguguaccgcgacgaggcucugaacaaucgguuucagauuaaaggaguugaacucaaguccggcuauaaagauuggauccuguggauuagcuucgccaucuccugcuuucuucuguguguggcccuccugggguucaucaugugggcuugccagaagggaaacauuagauguaauaucugcauuuga

SEQ ID NO: 184289 - RNA, 1701 nt, Artificial Sequence; identical to SEQ ID NO: 183657
  derived and/or modified sequence opt5 from hemagglutinin__InfluenzaA__ABI30799

SEQ ID NO: 184290 - RNA, 1701 nt, Artificial Sequence
  derived and/or modified sequence opt5 from hemagglutinin__InfluenzaA__ABI30810
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcaccaagaaacagcuucgggaaaacgcggaggauaugggaaauggcugcuucaagaucuaucacaagugugacaacgccugcauugggagcaucaaaaauggcacauacgaucaugacguguacagagacgaggcucugaacaaucgcuuucagauuaagggaguugaacucaaaucuggcuauaaggauuggauccuguggauuuccuucgccaucagcugcuuucuucuguguguggcccuccugggguucaucaugugggcuugccagaaaggaaacauucgguguaauaucugcauuuga

SEQ ID NO: 184291 - RNA, 1701 nt, Artificial Sequence
  derived and/or modified sequence opt5 from hemagglutinin__InfluenzaA__ABI30821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacguggcgaugcccaauaacgaggaguucgacaagcuguacauuuggggaguccaccauccugggaccuauaacgaucagaucucccucuacgcccaggcuagcggccgcauuacgguguccacaaaaagaucucaacagaccguuaucccgaauauugggagccggccccgcgugagagacaucccuucccggaucagcauuuacuggacaaucgucaagcccggagauauucugcugaucaacucuaccggcaaucucauugccccucgcggguauuuuaaaaucagauccggaaagagcucuaucaugcggagcgacgcucccauuggcaaguguaacuccgaaugcaucaccccgaauggcucuauuccuaacgacaaacccuuccagaaugugaaccgcaucacauacggggccuguccuagauaugugaagcagaauacgcugaaacuugcgaccggaaugcggaacguccccgagaagcaaacacgcggcauuuuuggggccaucgcuggauucaucgaaaauggcugggaggggaugguugauggaugguacggcuuuagacaccagaacagcgagggcauugggcaggccgcugaccugaaauccacccaagccgccaucgaucagauuaauggaaagcucaaccggcugaucggcaaaacaaaugaaaaguuccaccagauugagaaggaguucagcgaaguggaagggagaauccaggaccuugagaaauauguggaggauaccaagauugaccuguggucuuacaacgcugaacuccuggucgcgcuggagaaccaacauacgaucgaucucacagacuccgaaaugaauaaacuguuugagcgcaccaagaaacagcuucgggaaaacgccgaggauaugggaaauggcugcuucaagaucuaucacaagugugacaacgcuugcauugggagcaucagaaauggcaccuacgaucaugacguguaccgcgacgaggcccugaacaaucgguuucagauuaaaggaguugaacucaagucuggcuauaaagauuggauccuguggauuuccuucgccaucagcugcuuucuucuguguguggcucuccugggguucaucaugugggccugccagaagggaaacauuagauguaauaucugcauuuga

SEQ ID NO: 184292 - RNA, 1701 nt, Artificial Sequence; identical to SEQ ID NO: 183657
  derived and/or modified sequence opt5 from hemagglutinin__InfluenzaA__ABI30832

SEQ ID NO: 184293 - RNA, 1701 nt, Artificial Sequence
  derived and/or modified sequence opt5 from hemagglutinin__InfluenzaA__ABI30843
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcacccggaagcagcuuagagaaaacgcggaggauaugggaaauggcugcuucaaaaucuaucacaagugugacaacgccugcauugggagcauccgcaauggcacauacgaucaugacguguaccgggacgaggcucugaacaauagauuucagauuaagggaguugaacucaaaucuggcuauaaggauuggauccuguggauuuccuucgccaucagcugcuuucuucuguguguggcccuccugggguucaucaugugggcuugccagaaaggaaacauucgcuguaauaucugcauuuga

SEQ ID NO: 184294 - RNA, 1701 nt, Artificial Sequence; identical to SEQ ID NO: 184237
  derived and/or modified sequence opt5 from hemagglutinin__InfluenzaA__ABI30865

SEQ ID NO: 184295 - RNA, 1707 nt, Artificial Sequence
  derived and/or modified sequence opt5 from hemagglutinin__InfluenzaA__ABI36155
auggagaagaucgugcugcuccuggccaccgucagccuuguuaaauccgaccagauuugcaucggcuaccacgcuaacaauucuacagaacaaguggauacgauuauggagaagaacgugaccgucacacaugcccaggacauccuggaaaagacccacaaugggaaacucugugaucuggacggagugaaaccccuuauucugagagauugcagcguugcgggcuggcuccuggggaacccuaugugugacgaguucaucaaugugccggaaugguccuauaucgucgagaaggcuaaccccgccaauggacugugcuacccuggcaacuuuaaugauuaugaggaacucaagcaucugcuuucucggauuaaccacuucgagaaacugcagaucauucccaagagcuccuggucugaccaugaagccagccucgggguguccagcgcuuguccuuaccugggaagaucuuccuuuuuccgcaauguuguguggcuuaucaaaaagaacaauacauaucccaccauuaaacggagcuacaacaauacaaaccaggaggaucugcucguccuguggggcauccaccacccuaacgacgccgcugagcaaacccgccuguaucagaauccgacgaccuacauuucugugggcacauccacccucaaccagagacuggugcccaagaucgccacacggagcaaggucaaugggcagucuggacgcauggaauuuuucuggaccauccuuaaaccuaacgaugcgauuaauuuugaguccaacggcaauuucaucgcccccgaauacgcuuauaagauuguuaaaaagggggacagcgccaucaugaaauccgagcuggaauacggagauugcaacacgaagugucaaacaccuaugggcgcuauuaauucuagcaugccccuccauaacauccacccgcugaccaucggggagugcccuaaauaugugaaguccaauagacuugugcuggccacaggacuccggaacagcccccagcgcgagagacggcgcaagaaaagaggccuguuuggcgcgauugccggguucaucgaaggaggcuggcaggggauggucgacggaugguacggcuaucaucacucuaaugagcagggguccggauacgcugccgacaaggaaagcacccaaaaagcuauugauggcgugaccaacaagguuaauucuaucauugacaaaaugaacacacaguuugaggccgugggccgggaguucaacaaucuggaacgcagaaucgagaaccucaauaagaagauggaagauggguuucuggacgucuggacguauaacgccgagcuucuggugcucauggaaaaugagcggacccuggauuuccacgacagcaacguuaaaaaucuuuacgauaaggugagacugcagcuccgcgacaacgcuaaagaacugggaaauggcuguuucgaguuuuaccauaagugcgauaacgaguguauggaauccauccggaaugggacauauaacuacccucaauauucugaggaagcgagacugaaacgcgaggagauuagcggagucaagcucgaauccaucggcauuuaccagauccugagcauuuauucuaccguggccuccagccuugcucuggccaucaugauggccgggcucucucuguggaugugcuccaauggcagccugcagugccgggucuguauuuga

SEQ ID NO: 184296 - RNA, 1707 nt, Artificial Sequence
  derived and/or modified sequence opt5 from hemagglutinin__InfluenzaA__ABI36166
auggagaagaucgugcugcuccuggccaccgucagccuuguuaaauccgaccagauuugcaucggcuaccacgcuaacaauucuacagaacaaguggauacgauuauggagaagaacgugaccgucacacaugcccaggacauccuggaaaagacccacaaugggaaacucugugaucuggacggagugaaaccccuuauucugagagauugcagcguugcgggcuggcuccuggggaacccuaugugugacgaguucaucaaugugccggaaugguccuauaucgucgagaaggcuaaccccgccaauggacugugcuacccuggcaacuuuaaugauuaugaggaacucaagcaucugcuuucucggauuaaccacuucgagaaacugcagaucauucccaagagcuccuggucugaccaugaagccagccucgggguguccagcgcuuguccuuaccugggaagaucuuccuuuuuccgcaauguuguguggcuuaucaaaaagaacaauacauaucccaccauuaaacggagcuacaacaauacaaaccaggaggaucugcucguccuguggggcauccaccacccuaacgacgccgcugagcaaacccgccuguaucagaauccgacgaccuacauuucugugggcacauccacccucaaccagagacuggugcccaagaucgccacacggagcaaggucaaugggcagucuggacgcauggaauuuuucuggaccauccuuaaaccuaacgaugcgauuaauuuugaguccaacggcaauuucaucgcccccgaauacgcuuauaagauuguuaaaaagggggacagcgccaucaugaaauccgagcuggaauacggagauugcaacacgaagugucaaacaccuaugggcgcuauuaauucuagcaugcccuuucauaacauccacccgcucaccaucggggagugcccuaaauaugugaaguccaauagacuggugcuugccacaggacugcggaacagcccccagcgcgagagacggcgcaagaaaagaggccucuucggcgcgauugccggguuuaucgaaggaggcuggcaggggauggucgacggaugguacggcuaucaucacucuaaugagcagggguccggauacgcugccgacaaggaaagcacccaaaaagcuauugauggcgugaccaacaagguuaauucuaucauugacaaaaugaacacacaguucgaggccgugggccgggaauuuaacaaucuggagcgcagaaucgagaaccugaauaagaagauggaagauggguuccucgacgucuggacguauaacgccgagcugcuugugcugauggaaaaugagcggacccucgauuuccacgacagcaacguuaaaaaucuguacgauaaggugagacuucagcugcgcgacaacgcuaaagaacucggaaauggcuguuuugaguucuaccauaagugcgauaacgaguguauggaauccauccggaaugggacauauaacuacccucaauauucugaggaagcgagacugaaacgcgaggagauuagcggagucaagcuggaauccaucggcauuuaccagauccucagcauuuauucuaccguggccuccagccuggcucuugccaucaugauggccgggcugucucucuggaugugcuccaauggcagccugcagugccgggucuguauuuga

SEQ ID NO: 184297 - RNA, 1707 nt, Artificial Sequence; identical to SEQ ID NO: 184296
  derived and/or modified sequence opt5 from hemagglutinin__InfluenzaA__ABI36177

SEQ ID NO: 184298 - RNA, 1707 nt, Artificial Sequence
  derived and/or modified sequence opt5 from hemagglutinin__InfluenzaA__ABI36406
auggagaagaucgugcugcuccuggccaccgucagccuuguuaaauccgaccagauuugcaucggcuaccacgcuaacaauucuacagaacaaguggauacgauuauggagaagaacgugaccgucacacaugcccaggacauccuggaaaagacccacaaugggaaacucugugaucuggacggagugaaaccccuuauucugagagauugcagcguugcgggcuggcuccuggggaacccuaugugugacgaguucaucaaugugccggaaugguccuauaucgucgagaaggcuaaccccgccaauggacugugcuacccuggcaacuuuaaugauuaugaggaacucaagcaucugcuuucucggauuaaccacuucgagaaacugcagaucauucccaagagcuccuggucugaccaugaagccagccucgggguguccagcgcuuguccuuaccugggaagaucuuccuuuuuccgcaauguuguguggcuuaucaaaaagaacaauacauaucccaccauuaaacggagcuacaacaauacaaaccaggaggaucugcucguccuguggggccugcaccacccuaacgacgccgcugagcaaacccgccucuaucagaauccgacgaccuacaucucugugggcacauccacccugaaccagagacuugugcccaagauugccacacggagcaaggucaaugggcagucuggacgcauggaauuuuucuggaccauccugaaaccuaacgaugcgaucaauuuugaguccaacggcaauuucauugcccccgaauacgcuuauaagaucguuaaaaagggggacagcgccauuaugaaauccgagcucgaauacggagauugcaacacgaagugucaaacaccuaugggcgcuaucaauucuagcaugcccuuucauaacauucacccgcugaccaucggggagugcccuaaauaugugaaguccaauagacuugugcuggccacaggacuccggaacagcccccagcgcgagagacggcgcaagaaaagaggccuguucggcgcgaucgccggguuuauugaaggaggcuggcaggggauggucgacggaugguacggcuaucaucacucuaaugagcagggguccggauacgcugccgacaaggaaagcacccaaaaagcuaucgauggcgugaccaacaagguuaauucuauuaucgacaaaaugaacacacaguucgaggccgugggccgggaauuuaacaaucuggagcgcagaauugagaaccucaauaagaagauggaagauggguuccuggacgucuggacguauaacgccgagcuucuggugcucauggaaaaugagcggacccuggauuuccacgacagcaacguuaaaaaucuuuacgauaaggugagacugcagcuccgcgacaacgcuaaagaacugggaaauggcuguuuugaguucuaccauaagugcgauaacgaguguauggaauccauccggaaugggacauauaacuacccucaauauucugaggaagcgagacugaaacgcgaggagaucagcggagucaagcucgaauccauuggcaucuaccagauucugagcaucuauucuaccguggccuccagccuugcucuggccauuaugauggccgggcucucucuguggaugugcuccaauggcagccugcagugccgggucuguaucuga

SEQ ID NO: 184299 - RNA, 1707 nt, Artificial Sequence
  derived and/or modified sequence opt5 from hemagglutinin__InfluenzaA__ABI36450
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggggaaaacacacaauggaaagcucugugaucuggacggcgugaaaccccuuauccugagagauugcagcguugcgggguggcuccugggaaacccuaugugugacgaauuuaucaaugugccggagugguccuauauugucgaaaaggcuaaccccaccaaugaucugugcuacccuggcucuuuuaacgacuaugaggagcucaagcaucugcuuagccggaucaaucacuucgagaaaauucagaucauucccaaguccucuuggagcgaucaugaagccuccagcggggugucuuccgccuguccuuaccugggaagccccucuuucuuccgcaacguuguguggcucaucaaaaagaacuccacauauccuaccauuaaaacaagcuacaauaauaccaaccaggaagaccugcuuguccuguggggcauccaccacucuaaugaugcugccgagcaaacgagacucuaucagaacccgaccacauacaucuccauuggcaccagcacacugaaccagcggcuggugcccaagaucgcuacccgcuccaaggugaaugggcagucuggaagaauggaguuuuucuggacgauucucaaaccuaacgacgccaucaauuuugaaagcaacggcaauuucauugcgcccgaguacgccuauaagaucgucaaaaagggggauuccgcuaucaugaaaagcgaacuggaguacggaaacugcaauacaaagugucaaaccccuaugggcgccauuaacucuuccaugcccuuucauaauauccacccgcuuacaauuggggaaugcccuaaauauguuaagagcaaccggcuggugcucgcuaccggacugcgcaauucuccccagagagagagccggcgcaagaaaagaggccuuuucggcgccaucgcgggguuuauugagggaggcuggcaggggaugguggacggaugguacggcuaucaucacuccaacgaacaggggucuggauacgccgcugacaaggagagcacccaaaaagccaucgauggcgucacaaauaaggugaacuccaucauugacaaaaugaauacgcaguucgaagcuguuggccgggaguuuaacaaccuggaacgcagaaucgagaaucucaacaagaagauggaggauggguuccuggacguguggaccuauaaugccgaacugcucguccugauggagaacgaacggacacuugauuuccacgacagcaaugugaaaaaccuguacgauaagguucgccuccagcugagagacaaugccaaagagcuuggaaacggcuguuuugaguucuaccauaagugcgauaaugaauguauggagucuauucggaacgggaccuauaauuacccucaauauuccgaagaggcuagacugaaacgcgaagagaucagcggagugaagcucgagucuauuggcacauaccagauccuguccauuuauagcaccgucgcguccucucuggcccucgcuaucaugaucgccgggcugagccuuuggaugugcuccaacggcucucugcagugccggauuuguaucuga

SEQ ID NO: 184300 - RNA, 1707 nt, Artificial Sequence
  derived and/or modified sequence opt5 from hemagglutinin__InfluenzaA__ABI49396
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggggaaaacacacaauggaaagcucugugaucuggacggcgugaaaccccuuauccugagagauugcagcguugcgggguggcuccugggaaacccuaugugugacgaauuuaucaaugugccggagugguccuauauugucgaaaaggcuaaccccaccaaugaucugugcuacccuggcucuuuuaacgacuaugaggagcucaagcaucugcuuagccggaucaaucacuucgagaaaauucagaucauucccaaguccucuuggagcgaucaugaagccuccagcggggugucuuccgccuguccuuaccugggaagccccucuuucuuccgcaacguuguguggcucaucaaaaagaacuccacauauccuaccauuaaaaagagcuacaauaauacaaaccaggaagaccugcuuguccuguggggcauccaccacccgaaugaugcugccgagcaaaccagacucuaucagaaccccacgaccuacaucucuauuggcacauccacccugaaccagcggcuggugccuaagaucgcuacacgcagcaaagugaaugggcaguccggaagaauggaguuuuucugggccauucucaagcccaacgacgcgaucaauuuugaaucuaacggcaauuucauugccccugaguacgcuuauaaaaucgucaagaaaggggauagcgccaucaugaaguccgaacuggaguacggaaacugcaauaccaaaugucaaacgcccaugggcgcuauuaacagcucuaugccguuucauaauauccacccucuuacaauuggggaaugccccaaguauguuaaguccaaccggcuggugcucgccaccggacugcgcaauagcccucagagagagucucggcgcaaaaagagaggccuuuucggcgcgaucgccggguuuauugagggaggcuggcaggggaugguggacggaugguacggcuaucaucacagcaacgaacagggguccggauacgcugccgacaaagagucuacacaaaaggcuaucgauggcgucaccaauaaagugaacagcaucauugacaagaugaauacccaguucgaagccguuggccgggaguuuaacaaccuggaacgcagaaucgagaaucucaacaagaaaauggaggauggguuccuggacguguggacauauaaugccgaacugcucguccugauggagaacgaacggacgcuugauuuccacgacuccaaugugaagaaccuguacgauaaaguucgccuccagcugagagacaaugcuaaggagcuuggaaacggcuguuuugaguucuaccauaaaugcgauaaugaauguauggagagcauucggaacgggaccuauaauuacccccaauauucugaagaggcgagacugaagcgcgaagagaucuccggagugaagcucgagagcauuggcacauaccagauccugucuauuuauuccaccgucgccagcucccuggcucucgccaucaugaucgccgggcugucucuuuggaugugcagcaacggcucccugcagugccggauuuguaucuga

SEQ ID NO: 184301 - RNA, 1704 nt, Artificial Sequence
  derived and/or modified sequence opt5 from hemagglutinin__InfluenzaA__ABI85000
augaacacccagauccuggccuucauugcuugcaugcucaucggcacaaagggggacaaaauuugucugggacaccaugccguggcgaauggcacgaaggucaacacccuuacagagagagggaucgaaguugugaaugcuaccgagacaguggaaaccgucaacauuaaaaagaucugcacacaaggaaaacggcccaccgaucugggccagugugggcuccugggaacgcuuaucggcccuccgcagugcgaccaguuucuggaguucgaugccaaucucauuaucgaacgcagagagggcaccgacguguguuaccccgggaaguuuacaaacgaggaaagccugcggcaaauucugcgcggauccggcgggaucgauaaggagucuaugggauucaccuauagcggcauuagaacaaauggggccaccuccgcuugccggcgcucuggaagcuccuuuuacgccgaaaugaaauggcuccugucuaacagcgacaaugcugccuucccucagaugacgaaguccuauagaaacccccggaauaaaccugcgcuuaucauuuggggcguucaccauagcggcucugccacagagcagaccaagcuguacggguccggaaacaaacucaucacagugggcagcucuaaguaucagcaauccuuuacccccagcccuggggcucgcccgcaggucaauggacagucuggcagaaucgauuuccacuggcugcuucuggaccccaacgauaccgugacauuuacguucaauggggccuuuauugcuccugaccgggccuccuucuuucgcggagagagccucggcguucaguccgaugugccccuggacucuggcugugaaggggauugcuuccauagcggaggcaccaucgucuccagccugccuuuccaaaacauuaaccccagaacaguggggaaguguccgcgguacgugaaacagaccucucuccugcuugcgacaggaaugcgcaaugucccugagaaccccaagcaggccuaucagaaaagaaugacccggggccuguuuggggcuaucgccggcuucauugaaaauggaugggagggccucaucgacgggugguacggauuuagacaccaaaacgcucagggcgaagggacggccgccgacuacaaguccacacagagcgcuaucgaucaaauuaccggaaaacugaaucgccuuaucgacaagaccaaccagcaguucgagcugauugauaaugaguuuucugaaaucgagcagcaaauuggcaacguuaucaauuggacacgggacagcaugaccgaagugugguccuauaacgcggagcuccugguggccauggaaaaucagcacacaaucgaucuggcugacucugagaugaacaaacucuacgagagaguccgcaagcagcugcgggaaaaugccgaggaagaugggacgggcugcuucgagauuuuucauaagugugacgaucagugcauggaaagcaucagaaacaauaccuaugaccacacacaauaccgcaccgagucccuucagaaccggauucagaucgauccugugaaacugagcucuggauauaaggacauuauccucugguucuccuuuggcgccagcugcuuccugcuucuggcuauugccauggggcucguuuuuaucuguaucaaaaacggaaauaugagaugcacaauuuguaucuga

SEQ ID NO: 184302 - RNA, 1701 nt, Artificial Sequence; identical to SEQ ID NO: 183854
  derived and/or modified sequence opt5 from hemagglutinin__InfluenzaA__ABI92291

SEQ ID NO: 184303 - RNA, 1701 nt, Artificial Sequence
  derived and/or modified sequence opt5 from hemagglutinin__InfluenzaA__ABI92302
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaagucuuccuuuuaucggaaucuccuguggcuuaccgagaaaaacggcagcuacccuaaucuguccaagucuuaugucaacaauaaggaaaaagaggugcucguucuguggggagugcaucaccccagcaacaucgaagaccagaagacaauuuaccgcaaagagaaugccuacgucuccguggugagcucucacuauaacagacgguucaccccugaaaucgcgaagcgcccgaaagucagagaucaggaggggcggauuaacuacuauuggacacugcucgagcccggcgacaccaucauuuuugaagccaaugggaaccugaucgcuccuugguacgccuucgcucuuucccgcggauuuggcagcgggauuaucacgucuaaugccagcauggaugagugugacgcgaagugccagacaccccaaggagccaucaacuccucucugccuuuccagaauguucaucccgugaccauuggcgaauguccgaaauaugugagaagcacaaagcuccggauggucaccggccugcgcaacaucccuuccauucagagcagagggcuuuuuggagcuaucgccggcuucauugaagggggauggaccggcaugaucgaugggugguacggauaucaccaucagaaugaacaaggcucuggcuacgcugccgaccagaaguccacacagaacgccaucaaugggauuacgaacaaagugaauagcguuaucgagaagaugaacauucaguuuaccgcugugggaaaagaguucaauaagcuggaaaaacggauggagaaccucaauaagaaggucgaugacggcuuccuggacaucuggacauacaacgcggaacugcucgugcugcuugagaacgaacgcacccuggauuuucacgacucuaauguuaaaaaccucuaugagaaggugaaaucccaacugaagaauaacgccaaagagauugggaauggaugcuucgaauuuuaccacaaguguaacaaugagugcauggaaagcgucaagaacggcacauaugauuaccccaaauauuccgaggagucuaaacuuaauagagagaagaucgacggggugaagcuggagagcaugggcgucuaccagauccucgcuauuuauuccaccguggccucuagccugguucugcucgugucccugggagccaucagcuucuggaugugcucuaacggcucccuucagugucggauuugcaucuga

SEQ ID NO: 184304 - RNA, 1701 nt, Artificial Sequence
  derived and/or modified sequence opt5 from hemagglutinin__InfluenzaA__ABI92313
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcaucuccagcuuugaacgcuucgagauuuuucccaaggagucuuccuggccuaaucauaccguuacaaagggagugaccgcuagcugcucucacaacggcaaauccagcuucuacaagaaucugcucuggcugacagaaaagaacggccuuuaucccaaucugucuaaguccuacgucaacaauaaagagaaggaagugcucguucuguggggagugcaucacccuagcaacaucggggaucagagagccaucuaccacaccgagaacgcguaugucuccguggugucuagccauuacucccggcgcuuuacgccggaaauuacaaagagacccaaaguccgggaccaggagggccgcaucaauuauuacuggacccugcucgagccuggggauacaauuaucuucgaagccaacggaaaucugauugcucccugguaugccuuugcucuuagcagaggcuucgggucuggaaucauuaccuccaacgccagcaugggcgagugugacgcgaagugccagaccccucaaggcgccaucaauucuagccugcccuuucagaacguucacccggugacaaucggggaauguccuaaauacgugcgguccacgaagcuccgcauggucaccggacugagaaauauucccucuauccagagccggggccuuuucggggcuauugccggauuuaucgagggcggguggacaggaaugauugauggcugguauggcuaccaucaccagaacgaacaaggguccggauacgcugccgaccagaaaagcacccagaaugccaucgauggcaucacaaacaagguuaauucugugauugagaaaaugaacacccaguucacggcuguggggaaggaguucaauaagcuggaacgcagaauggagaaccucaauaaaaaggucgacgauggauuucuggacaucuggacauauaacgcggaacugcucgugcugcuugagaacgaacggacccuggacuuccacgauuccaauguuaaaaaccucuacgagaaggugaaaaaucaacugaagaacaaugccaaggagauuggcaacgggugcuuugaguucuaucauaaauguaauaacgaaugcauggaaagcgucaagaauggcaccuacgacuauccuaaauacucugaggaguccaaacuuaaccgcgagaaaaucgauggagugaagcuggaaagcaugggcgucuaucacauucucgcuaucuacuccacaguggccucuagccugguucugcucgugucccugggggccaucucuuuuuggaugugcagcaauggaucccuucaguguagaauuugcaucuga

SEQ ID NO: 184305 - RNA, 1701 nt, Artificial Sequence
  derived and/or modified sequence opt5 from hemagglutinin__InfluenzaA__ABI92324
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuaugccugcaagcggggcuccgucaacagcuuuuucucucgccucaauuggcugcacaaacuugaguacaaguauccugcgcugaacgugacaaugcccaauaacgggaaauuugacaagcucuacaucuggggaguucaucacccuuccaccgauagcgaccaaacaucucuguacgugagagccuccggcaaagucaccgugagcacgaagcggucccagcagacagugauuccgaauaucggguuccgccccugggucagaggacugucuagccggauuuccaucuauuggaccauuguuaagccuggcgacauccuccugaucaacagcacagggaaccuuauugcuccccgcggauacuuuaaaaucagaaauggcaagucuuccauuaugcggagcgaugccccuaucggcaacuguucuagcgagugcauuacccccaauggguccaucccgaacgacaaaccuuuccagaaugugaaccgcaucaccuauggagcuugucccagauacgugaagcaaaauacacugaaacucgccacgggcaugcggaacgucccugaaaagcagacccgcgggauuuuuggagcgaucgccggcuucauugagaaugggugggaaggaaugguggauggcugguauggcuuuagacaccagaacucugaggggacaggacaggcugccgaccugaaaagcacccaagcugccaucgaucagauuaauggcaaacuuaaccggcugaucgagaagacaaaugaaaaguuccaucagaucgagaaggaguucuccgaaguugaagggcgcauucaagaccucgagaaauacguggaggauaccaagaucgaccuguggagcuauaacgccggacugcucgucgcucuggaaaaucagcacacgauugaucuuacagacucugagaugaacaaacuguuugaaagaacccggaagcagcucagagagaacgcggaagauaugggcaaugggugcuucaagaucuaccauaaaugugacaacgccugcauuggcuccauccgcaauggaaccuacgaccacgauguguaucgggacgaggcucugaacaauagauuucagauuaagggcguugagcuuaaaagcggguacaaggauuggauccuguggaucucuuucgccauuuccugcuuucuccugugugugguccugcucggauucaucaugugggccugccaaaaaggcaacauucgcuguaauaucugcauuuga

SEQ ID NO: 184306 - RNA, 1701 nt, Artificial Sequence
  derived and/or modified sequence opt5 from hemagglutinin__InfluenzaA__ABI92335
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagccuguacgcgcaggccuccgggagagugaccgucucuacgaagcggagccaacagacagugauuccgaacaucggaucccgccccugggugagaggcgucagcucucggauuuccaucuacuggaccauuguuaaaccuggggacauccugcucaucaacagcacaggaaaucugauugcuccccgcggcuauuucaagaucagaucuggaaagagcuccauuaugcggucugacgccccuaucgggaaauguaacagcgaaugcauuacccccaauggcuccaucccgaacgauaagccuuuucagaaugugaaccgcaucaccuacggcgcuugucccagauaugugaaacagaauacacuuaagcuggccacggggaugcggaacgucccugagaaacaaacccgcggaauuuucggcgcgaucgccggguuuauugaaaauggaugggagggcaugauggacgggugguacggauucagacaccagaacagcgagggcacaggccaggcugccgaucucaagucuacccaagcugccaucaaucagauuaacgggaaacugaaucggcuuaucgaaaagacaaacgagaaguuucaucagaucgaaaaagaguucuccgaaguggagggacgcauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgggagaaugcggaggauaugggcaacgggugcuuuaagaucuaucauaaaugugacaaugccugcaugggauccauuagaaacggcaccuacgaucacgacgucuaccgcgacgaagcucucaauaaccgguuccagaucaaggggguggagcugaaaagcggcuauaaggauuggauucuuuggaucuccuuugccaucucuugcuuccugcucuguauuguucugaugggauuuaucaugugggccugccagaaaggcaauauuagauguaacaucugcauuuga

SEQ ID NO: 184307 - RNA, 1701 nt, Artificial Sequence
  derived and/or modified sequence opt5 from hemagglutinin__InfluenzaA__ABI92346
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccacauuaagggcguggagcugaaauccggauauaaggauuggguucuuuggaucagcuuugccaucuccugcuuccugcucuguauugugcugcugggcuuuaucaugugggccugccagaaagggaauauuagauguaacaucugcauuuga

SEQ ID NO: 184308 - RNA, 1701 nt, Artificial Sequence; identical to SEQ ID NO: 183306
  derived and/or modified sequence opt5 from hemagglutinin__InfluenzaA__ABI92357

SEQ ID NO: 184309 - RNA, 1701 nt, Artificial Sequence; identical to SEQ ID NO: 183306
  derived and/or modified sequence opt5 from hemagglutinin__InfluenzaA__ABI92368

SEQ ID NO: 184310 - RNA, 1698 nt, Artificial Sequence; identical to SEQ ID NO: 184228
  derived and/or modified sequence opt5 from hemagglutinin__InfluenzaA__ABI92379

SEQ ID NO: 184311 - RNA, 1701 nt, Artificial Sequence
  derived and/or modified sequence opt5 from hemagglutinin__InfluenzaA__ABI92390
augaagaccaucauugccuucagcuacauccugugccucguguuugcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgggaucugcgacucuccgcaccagauccuggauggagagaauuguacccuuauugacgcccugcucggcgauccccagugcgacggguuccaaaacaaaaagugggaucuguuugucgaaagaagcaaagccuauuccaauuguuacccuuaugacgugcccgauuacgcuucucugcggagccucguugccuccagcggaacgcuggaguucaacaaugaaucuuuuaacuggaccggcgugacacagaauggcaccuccagcgcuugcaagcgcagaucuaacaauuccuucuuuagccggcuuaacuggcugacacaucucaaguucaaauauccugcccugaaugucaccaugcccaacaacgagaaguuugacaaacuuuacaucuggggagugcaccauccugggacggauaaugaccagacaucucuguaugcgcaggccuccggccgcauuaccguuagcacaaagagaucccaacagaccgugaccccgaacaucgggucucggccccgcgucagagauauuccuagccggaucuccauuuacuggacaaucgugaaacccggagacauccuccugauuaauagcacgggcaaccugaucgcuccucgcggguacuucaagauuagaucuggaaaguccagcaucaugcggucugacgcccccauuggcaaauguaauagcgagugcaucaccccgaacggcuccaucccuaaugauaagcccuuucagaacgugaaucgcauuacauauggggcuuguccuagauacgucaaacagaacacccucaagcuggccacaggaaugcggaauguucccgaaaaacaaacccgcggcaucuucggggcgauugccggauuuaucgagaacggcugggaagggaugguggacggaugguauggcuucagacaccaaaauucugagggcacggggcaggcugccgaucuuaagagcacacaggcugccauuaaccagaucaauggaaaacugaaccggcucaucggcaagaccaacgagaaguuccaccagauugaaaaagaguuuuccgaaguggaggggagaauccaggaccuggaaaaguacgucgaggauaccaaaauugaccuuuggagcuauaaugccgagcugcucguggcucuggaaaaccaacauacaaucgaucugaccgacucugagaugaauaaacucuucgaacgcacaaagaagcagcugcgggagaacgcggaagauaugggaaauggcugcuuuaagauuuaccacaaaugugacaacgccugcaucggguccauuagaaauggcacguaugaucaugacguuuaccgcgacgaggcucuuaacaaucgguuccagaucaagggaguggagcugaaaagcggcuacaaggauuggauccucuggauuucuuuugccaucuccugcuuccugcuuugugucgcccugcucggguuuauuaugugggcuugccagaaaggaaacaucagauguaauauuugcaucuga

SEQ ID NO: 184312 - RNA, 1701 nt, Artificial Sequence; identical to SEQ ID NO: 183306
  derived and/or modified sequence opt5 from hemagglutinin__InfluenzaA__ABI92401

SEQ ID NO: 184313 - RNA, 1701 nt, Artificial Sequence
  derived and/or modified sequence opt5 from hemagglutinin__InfluenzaA__ABI92412
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccagugcgacggguuucaaaacaaaaagugggaucucuucgucgaaagaagcaaagccuauuccaauuguuacccuuaugacgugcccgauuacgcuucucugcggagccuuauugccuccagcggaacgcuggaguuuaacaaugaaucuuucaacuggaccggcguuacacagaauggcaccuccagcgcuugcaagcgcagaucuaacuccagcuuuuucucucggcucaauuggcugacacaucuuaaguuuaaauauccugcccugaacgugaccaugcccaauaacgaggaguucgacaagcucuacaucuggggaguccaccauccugggacguauaacgaucagauuucccuguacgcgcaggccagcggccgcaucacaguguccaccaaaagaucucaacagacaguuauuccgaauaucgggagccggccccgcgugagagacauuccuucccggaucagcaucuacuggaccauugucaagcccggagauauccugcucauuaacucuaccggcaaucugaucgcuccucgcggguauuuuaaaauuagauccggaaagagcucuaucaugcggagcgacgcccccaucggcaaguguaacuccgaaugcauuacaccgaauggcucuaucccuaacgacaaacccuuccagaauauuaaccgcaucacguacggggcuuguccuagauaugugaagcagaauacccuuaaacuggccacaggaaugcggaacgugcccgagaagcaaacccgcggcauuuuuggggcgaucgccggauucaucgaaaauggcugggaggggauggucgauggaugguacggcuuuagacaccagaacagcgagggcauugggcaggcugccgaccucaaauccacacaagcugccaucgaucagauuaauggaaagcugaaccggcuuaucggcaaaaccaaugaaaaguuccaccagauugagaaggaguucagcgaaguugaagggagaauccaggaccuggagaaauauguggaggauacgaagauugaccucuggucuuacaacgccgaacugcugguggcucucgagaaccaacauacaaucgaucugaccgacuccgaaaugaauaaacuuuuugagcgcaccaagaaacagcugcgggaaaacgcggaggauaugggaaauggcugcuucaagaucuaucacaagugugacaacgccugcauugggagcaucagaaauggcacauacgaucaugacgucuaccgcgacgaggcucucaacaaucgguuucagauuaaaggaguggaacugaagucuggcuauaaagauuggauccuuuggauuuccuucgccaucagcugcuuucugcucuguguugcccugcugggguucaucaugugggcuugccagaagggaaacauuagauguaauaucugcauuuga

SEQ ID NO: 184314 - RNA, 1701 nt, Artificial Sequence
  derived and/or modified sequence opt5 from hemagglutinin__InfluenzaA__ABI92423
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgauaagcaaacccgcggcauuuuuggggcgaucgccggauucaucgagaauggcugggaagggaugguugacggaugguacggcuuuagacaccagaacagcgagggcauugggcaggcugccgaucugaaauccacacaagcugccaucgaccagauuaauggaaagcucaaccggcugaucggcaaaaccaaugagaaguuccaccagauugaaaaggaguucagcgaaguggaggggagaauccaggaucuugaaaaauauguggaggacacgaagauugaucuguggucuuacaacgccgagcuccuggucgcucuggaaaaccaacauacaaucgaccucaccgauuccgagaugaauaaacuguuugaacgcaccaagaaacagcuucgggagaacgcggaagacaugggaaauggcugcuucaagaucuaucacaagugugauaacgccugcauugggagcaucagaaauggcacauacgaccaugacguguaccgcgaugaggcucugaacaaucgguuucagauuaaaggaguugagcucaagucuggcuauaaagacuggauccuguggauuuccuucgccaucagcugcuuucuucuguguguggcccuccugggguucaucaugugggcuugccagaagggaaacauuagauguaauaucugcauuuga

SEQ ID NO: 184315 - RNA, 1701 nt, Artificial Sequence; identical to SEQ ID NO: 183657
  derived and/or modified sequence opt5 from hemagglutinin__InfluenzaA__ABI92434

SEQ ID NO: 184316 - RNA, 1701 nt, Artificial Sequence
  derived and/or modified sequence opt5 from hemagglutinin__InfluenzaA__ABI92445
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgggaucugcgacucuccgcaccagauccuugauggagagaauuguacgcugauugacgcucuccugggcgauccccagugcgacggguuucaaaacaaaaagugggaucuguucgucgaaagaagcaaagccuauuccaauuguuacccuuaugacgugcccgauuacgccucucuccggagccugaucgcuuccagcggaacccuugaguuuaacaaugaaucuuucaacuggacaggcguuaaucagaacggcaccuccagcgccugcaagcgcagaucuaauuccagcuuuuucucucggcugaacuggcucacacaucugaaguuuaaauauccugcucuuaaugugaccaugcccaacaacgaggaguucgacaagcuguacauuuggggaguccaccauccugggacguauaaugaucagaucucccucuacgcccaggcgagcggccgcauuacaguguccaccaaaagaucucaacagacaguuaucccgaacauugggagccggccccgcgugagagacaucccuucccggaucagcauuuacuggaccaucgucaagcccggagauauucugcugaucaauucuaccggcaaccucauugccccucgcggguauuuuaaaaucagauccggaaagagcucuaucaugcggagcgacgcucccauuggcaaguguaauuccgaaugcaucacaccgaacggcucuauuccuaaugacaaacccuuccagaacgugaaucgcaucacguacggggccuguccuagauaugugaagcagaacacccugaaacuugcuacaggaaugcggaauguccccgagaagcaaacccgcggcauuuuuggggccaucgcgggauucaucgaaaacggcugggaggggaugguugauggaugguacggcuuuagacaccagaauagcgagggcauugggcaggccgcugaccugaaauccacacaagccgcuaucgaucagauuaacggaaagcucaaucggcugaucggcaaaaccaacgaaaaguuccaccagauugagaaggaguucagcgaaguggaagggagaauccaggaccuugagaaauauguggaggauacgaagauugaccuguggucuuacaacgccgaacuccuggucgcccuggagaaucaacauacaaucgaucucaccgacuccgaaaugaacaaacuguuugagcgcaccaagaaacagcuucgggaaaaugcugaggauaugggaaacggcugcuucaagaucuaucacaagugugacaauacaugcauugggagcaucagaaacggcaccuacgaucaugacguguaccgcgacgaggcgcugaauaaccgguuucagauuaaaggaguugaacucaagucuggcuauaaagauuggauccuguggauuuccuucgccaucagcugcuuucuucuguguguggcucuccugggguucaucaugugggccugccagaagggaaauauuagauguaacaucugcauuuga

SEQ ID NO: 184317 - RNA, 1701 nt, Artificial Sequence; identical to SEQ ID NO: 183657
  derived and/or modified sequence opt5 from hemagglutinin__InfluenzaA__ABI92456

SEQ ID NO: 184318 - RNA, 1701 nt, Artificial Sequence; identical to SEQ ID NO: 184265
  derived and/or modified sequence opt5 from hemagglutinin__InfluenzaA__ABI92467

SEQ ID NO: 184319 - RNA, 1701 nt, Artificial Sequence; identical to SEQ ID NO: 183674
  derived and/or modified sequence opt5 from hemagglutinin__InfluenzaA__ABI92478

SEQ ID NO: 184320 - RNA, 1701 nt, Artificial Sequence; identical to SEQ ID NO: 184265
  derived and/or modified sequence opt5 from hemagglutinin__InfluenzaA__ABI92489

SEQ ID NO: 184321 - RNA, 1701 nt, Artificial Sequence
  derived and/or modified sequence opt5 from hemagglutinin__InfluenzaA__ABI92500
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgugaucaaccagauuaauggaaaacugaacagacuuaucgaaaagacaaaugagaaguuucaucagaucgaaaaagaguucucugaaguugagggccggauucaggaucuggagaaguauguggaagacaccaaaaucgaucucugguccuacaacgccgagcugcuggucgcucucgaaaaccaacacacgauugaccugacagauagcgagaugaauaaacuuuucgaaagaaccaagaagcagcugcgcgagaacgcggaggacauggggaauggauguuuuaagaucuaucauaaaugcgauaacgccugcauuggcucuauccggaaugggaccuacgaccacgauguguacagagacgaagcucucaacaaucgcuuccagauuaagggcguugagcugaaauccggauauaaggacuggauccuuuggaucagcuuugccauuuccuguuuccugcucugcgugguccugcugggcuuuaucaugugggccugucagaaagggaacauucggugcaauaucuguauuuga

SEQ ID NO: 184322 - RNA, 1701 nt, Artificial Sequence
  derived and/or modified sequence opt5 from hemagglutinin__InfluenzaA__ABI92511
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagaauagcagcacaggcauuaucugcgacuccccgcaccagauccuggauggggagaacuguacccucauugacgcccugcugggagauccccauugcgacggcuuucagaauaaagaaugggaucucuucgucgagagaucuaaggccuauagcaacuguuacccuuaugacgugcccgauuacgcuucccugcggucucuuguugccagcuccgggacgcuggaauuuaauaacgagagcuucaauuggaccggaguggcucaaaacggcacaucuuccgccugcaaacgcagaagcgacaagucuuucuucucccggcucaauuggcugcaccagcuuaaguauaaauacccugcgcugaacgucaccaugcccaauacagagaaguuugauaaacucuauaucuggggcgugcaucacccuagcaccgacucugaucagauuucccuguacgcccaggcuagcgggcgcguuacgguguccacaaagagaucucaacagaccgucaucccgaacauuggaagccggcccugggugcgcggcguguccagcagagucucuaucuacuggacaauuguuaaaccuggggacauccugcucaucaacuccaccggaaaucugauugcuccccggggcuauuucaagauccgcagcgggaagucuagcauuaugagauccgacgccucuaucggaaaauguaacagcaagugcauuaccccuaauggcuccauccccaacgauaaaccguuucagaaugugaaccggaucacauacggcgccuguccucgcuaugugaagcagaauacgcuuaaacuggcgaccgggaugagaaacguccccgaaaagcaaacacggggaauuuucggcgccaucgcuggguuuauugagaauggaugggaaggcaugguggacgggugguacggauuccgccaccagaacagcgagggcaccggccaggccgcugaucucaaaucuacacaagccgccaucaaucagauuaacgggaagcugaauagacuuaucgagaagaccaacgaaaaauuucaucagaucgagaaggaauuuuccgagguugaaggacggauucaggaccuggagaaauauguggaggauacgaagaucgaccucuggagcuacaaugcugaacugcuggucgcgcucgagaaccaacacacaauugaucugaccgacucugaaaugaacaaacuuuucgagagaaccaagaagcagcugcgcgaaaaugccgaggauaugggcaacgggugcuuuaaaaucuaucauaagugugacaauacaugcauuggauccauccggaacggcaccuacgaucacgacguguacagagacgaggcucucaauaaccgcuuccagauuaaagggguugaacugaagucuggcuauaaagauuggauccuuuggaucuccuuugccauuucuugcuuccugcucugugugguccugcugggauuuaucaugugggccugccagaagggcaauauucgguguaacaucugcauuuga

SEQ ID NO: 184323 - RNA, 1701 nt, Artificial Sequence
  derived and/or modified sequence opt5 from hemagglutinin__InfluenzaA__ABI92522
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucuaacaaguccuuuuucagccgccucaauuggcugcaccagcuuaaguauaaauacccugcccugaacgugaccaugcccaauaacgagaaguuugacaaacucuauauuuggggcguucaucacccugggacagauucugaccagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagauauccugcucaucaauuccacaggcaaccugauugcuccccgcggguauuucaagaucagaagcggaaagucuagcauuaugaaauccgacgccccuaucggcaaguguaauucugaaugcauuacccccaacggcagcaucccgaaugacaaaccuuuucagaacgugaaucggaucaccuacggggcuuguccccgcuaugugaagcagaacacacuuaaacuggccacgggaaugagaaaugucccugagaagcaaacccggggcauuuucggggcgaucgccggauuuauugaaaacggcugggaggggaugauggauggaugguacggcuuccgccaccaaaauuccgagggcacagggcaggcugccgaccucaaaagcacccaggcugccaucaaccagauuaauggaaagcugaacagacuuaucgaaaagacaaaugagaaauuucaucagaucgaaaaggaguucucugaaguggagggccggauucaggaucuggagaaauauguugaagacaccaagaucgaucucugguccuacaacgccgagcugcugguggcucucgaaaaccaacacacgauugaccugacagauagcgagaugaauaaacuuuucgaaagaaccaagaagcagcugcgcgagaacgcggaggacauggggaauggaugcuuuaaaaucuaucauaagugugauaacgccugcauuggcucuauccggaaugggaccuacgaccacgaugucuacagagacgaagcucucaacaaucgcuuccagauuaaaggcguggagcugaaguccggauauaaagacuggauccuuuggaucagcuuugccauuuccugcuuccugcucuguaucguucugcugggcuuuauuaugugggccugccagaaggggaacauccgguguaauauuugcaucuga

SEQ ID NO: 184324 - RNA, 1701 nt, Artificial Sequence
  derived and/or modified sequence opt5 from hemagglutinin__InfluenzaA__ABI92533
augaagaccaucauugcccugagcuacauccucugccugguguucgcucagaaacuucccggcaacgacaauuccagagccacacugugucucgggcaccaugcggucccuaacggaacgcugguuaagaccauuacaaaugaucaaaucgaggugaccaacgcuacagaacuugugcagucuagcuccaccggccggauuugcgacucuccgcaccagauccuggauggggagaauuguacacucaucgacgcccugcugggagauccccauugcgacggcuuucagaacaaagaaugggaucucuucgucgagcgcagcaaggccuauuccaauuguuacccuuaugacgugcccgauuacguuucucugagaagccuuguggcuuccagcgggacccuggaauuuaacaaugagucuuucaacuggacgggagucgcccaaaauggcaccuccagcgcuugcaaacggcgcucugacaaguccuuuuucagcagacucaacuggcugcaccagcuuaaguauaaauacccugcccugaaugugacaaugcccaacaaugagaaguuugauaaacucuauauuuggggcguucaucacccugggaccgacucugaucagaucucccuguacgcgcaggccagcggacgggugacagucuccaccaagcgcucucaacagacggugauuccgaacaucggcagcagacccugggugcgcggggucuccagccggauuucuaucuacuggacaauuguuaaaccuggagacauccugcucaucaacuccaccggcaaucugauugcucccagaggguauuucaagauccggagcggaaagucuagcauuaugcgcuccgacgccccuaucggcaaauguaacucugaaugcauuacacccaauggcagcaucccgaacgauaagccuuuucagaaugugaacagaaucaccuacgggcccuguccucgguaugugaaacagaauacccuuaagcuggcuacaggaaugcgcaacguccccgagaaacaaacgagaggcauuuucggggccaucgcgggauuuauugaaaauggcugggaggggaugauggacggaugguacggcuuccggcaccagaacuccgagggcaccgggcaggccgcugaucucaagagcacacaagccgcuaucaaucagauuaacggaaaacugaauagacuuaucgaaaagaccaacgagaaguuucaucagaucgaaaaagaguucucugaaguggagggccgcauucaggaccuggagaaguauguugaagauacaaaaaucgaccucugguccuacaaugccgagcugcugguggcccucgaaaaccaacacaccauugaucugacggacagcgagaugaacaaacuuuucgaacggacaaagaagcagcugagagagaaugcugaggauauggggaacggaugcuuuaagaucuaucauaaaugugacaaugcgugcauuggcucuauccgcaacgggaccuacgaucacgacgucuaccgggacgaagcccucaauaacagauuccagauuaagggcguggagcugaaauccggauauaaggauuggauccuuuggaucagcuuugcuauuuccugcuuccugcucuguaucguucugcugggcuuuauuaugugggccugccagaaagggaauauccgcuguaacauuugcaucuga

SEQ ID NO: 184325 - RNA, 1701 nt, Artificial Sequence; identical to SEQ ID NO: 184324
  derived and/or modified sequence opt5 from hemagglutinin__InfluenzaA__ABI92544

SEQ ID NO: 184326 - RNA, 1701 nt, Artificial Sequence
  derived and/or modified sequence opt5 from hemagglutinin__InfluenzaA__ABI92577
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagccgcgccuauuccaauuguuacccuuaugacgugcccgauuacguuucucugagaagccuuguggcuuccagcgggacgcuggaauuuaacaaugagucuuucaacuggaccggagucgcccaaaauggcacauccagcgcuugcaagcggcgcucugacaaauccuuuuucagcagacucaacuggcugcaccagcuuaaguauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugagaggggucuccagcaagauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccggauucaggaccuggagaaguauguugaagauaccaaaaucgaccucugguccuacaaugccgagcugcugguggcccucgaaaaccaacacacgauugaucugacagacagcgagaugaacaaacuuuucgaacgcaccaagaagcagcugcgggagaaugcugaggauauggggaacggaugcuuuaagaucuaucauaaaugugacaaugcgugcauuggcucuaucagaaacgggaccuacgaucacgacgucuaccgcgacgaagcccucaauaaccgguuccagauuaagggcguggagcugaaauccggauauaaggauuggauccuuuggaucagcuuugcuauuuccugcuuccugcucuguaucguucugcugggcuuuauuaugugggccugccagaaagggaauaucagauguaacauuugcaucuga

SEQ ID NO: 184327 - RNA, 1701 nt, Artificial Sequence; identical to SEQ ID NO: 184063
  derived and/or modified sequence opt5 from hemagglutinin__InfluenzaA__ABI92588

SEQ ID NO: 184328 - RNA, 1701 nt, Artificial Sequence
  derived and/or modified sequence opt5 from hemagglutinin__InfluenzaA__ABI92599
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggagcaaggccuauuccaacuguuacccuuaugaugugcccgacuacguuucucugcgcagccuuguggcuuccagcgggacgcuggaauuuaauaacgagucuuucaauuggaccggagucgcccaaaacggcacauccagcgcuugcaaaagacggucugauaaguccuuuuucagccgccucaauuggcugcaccagcuuaaguauaaauacccugcccugaacgugaccaugcccaauaacgagaaguuugacaaacucuauauuuggggcguucaucacccugggacagauucugaccagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagauauccugcucaucaauuccacaggcaaccugauugcuccccgcggguauuucaagaucagaagcggaaagucuagcauuaugcgguccgacgccccuaucggcaaauguaauucugaaugcauuacccccaacggcagcaucccgaaugacaagccuuuucagaacgugaaucgcaucaccuacggggcuugucccagauaugugaaacagaagacacuuaaacuggccacgggaaugcggaacgucccugagaagcaaacccgcggcauuuucggggcgaucgccggauuuauugaaaauggcugggaggggaugauggauggaugguacggcuucagacaccagaacuccgagggcacagggcaggcugccgaccucaaaagcacccaagcugccaucaaucagauuaacggaaagcugaaucggcuuaucgaaaagacaaacgagaaauuucaucagaucgaaaaggaguucucugaaguggagggccgcauucaggaucuggagaaauauguugaagacaccaagaucgaucucugguccuacaaugccgagcugcugguggcucucgaaaaccaacacacgauugaccugacagauagcgagaugaacaaacuuuucgaaagaaccaagaagcagcugcgggagaaugcggaggacauggggaacggaugcuuuaaaaucuaucauaagugugauaaugccugcauuggcucuaucagaaacgggaccuacgaccacgaugucuaccgcgacgaagcucucaauaaccgguuccagauuaaaggcguggagcugaaguccggauauaaagacuggauccuuuggaucagcuuugccauuuccugcuuccugcucuguaucguucugcugggcuuuauuaugugggccugccagaaggggaauaucagauguaacauuugcaucuga

SEQ ID NO: 184329 - RNA, 1701 nt, Artificial Sequence
  derived and/or modified sequence opt5 from hemagglutinin__InfluenzaA__ABI92610
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaauacacuuaagcuggccacgggaaugcggaacgucccugagaaacaaacccgcggcauuuucggggcgaucgccggauuuauugaaaauggcugggaggggaugauggacggaugguacggcuucagacaccagaacuccgagggcacagggcaggcugccgaucucaagagcacccaagcugccaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcucucgaaaaccaacacacgauugaucugacagacagcgagaugaacaaacuuuucgaaagaaccaagaagcagcugcgggagaaugcggaggauauggggaacggaugcuuuaagaucuaucauaaaugugacaaugccugcauuggcucuaucagaaacgggaccuacgaucacgacgucuaccgcgacgaagcucucaauaaccgguuccagauuaagggcguggagcugaaauccggauauaaggauuggauccuuuggaucagcuuugccauuuccugcuuccugcucuguaucguucugcugggcuuuauuaugugggccugccagaaagggaauaucagauguaacauuugcaucuga

SEQ ID NO: 184330 - RNA, 1701 nt, Artificial Sequence
  derived and/or modified sequence opt5 from hemagglutinin__InfluenzaA__ABI92621
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcaauucuccgcaccagauccuggacggggagaacuguacacucaucgaugcccugcugggagacccccauugcgaaggcuuucagaauaaagagugggaucucuucgucgaacggagcaaggccuauuccaacuguuacccuuaugacgugcccgauuacguuucucugcgcagccuuguggcuuccagcgggacccuggaguuuaauaacgagucuuucaauuggacgggagucgcccaaaacggcaccuccagcgcuugcaaaagacggucugacaaguccuuuuucagccgccucaauuggcugcaccagcuuaaguauaaauacccugcccugaacgugacaaugcccaauaacgaaaaguuugauaaacucuauauuuggggcguucaucacccugggaccgacucugaucagaucucccuguacgcgcaggccagcggaagagugacagucuccaccaagcggucucaacagacggugauuccgaacaucggcagccgccccugggugagaggggucuccagcaaaauuucuaucuacuggacaauuguuaagccuggagacauccugcucaucaauuccaccggcaaccugauugcuccccggggguauuucaagauccgcagcggaaaaucuagcauuaugagauccgaugccccuaucgacaaguguaauucugagugcauuacacccaacggcagcaucccgaaugacaaaccuuuucagaacgugaaucggaucaccuacggccuuuguccccgcuaugugaagcagaacacccugaaacucgcuacagggaugagaaaugucccugaaaagcaaacgcggggaauuuucggcgccaucgcgggguuuauugagaacggaugggagggcaugauggaugggugguacggauuccgccaccaaaauuccgaaggcaccggccaggccgcugaccugaaaagcacacaggccgcuaucaaccagauuaaugggaaacuuaacagacugaucgagaagaccaaugaaaaguuucaucagaucgagaaggaguucucugaaguggagggacggauucaggaucucgaaaaauauguugaggacacaaagaucgaucugugguccuacaacgccgaacugcucguggcccuggagaaccaacacaccauugaccuuacggauagcgaaaugaauaaacuguucgagagaacaaagaagcagcuccgcgagaacgcugaagacaugggcaaugggugcuuuaaaaucuaucauaagugugauaacgcgugcauuggaucuauccggaauggcaccuacgaccacgaugucuacagagacgaggcccugaacaaucgcuuccagauuaaagggguggaacuuaaguccggcuauaaagacuggauccuguggaucagcuuugcuauuuccugcuuccuccuguguaucguucugcucggauuuauuaugugggccugccagaagggcaacauccgguguaauauuugcaucuga

SEQ ID NO: 184331 - RNA, 1701 nt, Artificial Sequence; identical to SEQ ID NO: 183586
  derived and/or modified sequence opt5 from hemagglutinin__InfluenzaA__ABI92632

SEQ ID NO: 184332 - RNA, 1701 nt, Artificial Sequence
  derived and/or modified sequence opt5 from hemagglutinin__InfluenzaA__ABI92643
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccauccccaacaaugagaaauuugauaagcuguauauuuggggagugcaccauccugggacggacucugaucagaucucccucuacgcgcaggccagcggccgcauuacaguuuccaccaaaagaucucaacagacagugaucccgaacauugggagccggccccgcgucagagacguguccagccggaucucuaucuacuggaccauugugaagccuggagacauccugcugauuaacuccaccggcaaucucaucgcuccccgcggguauuucaagauuagaagcggaaaaucuagcaucaugcgguccgaugccccuaucggcaaguguaacucugagugcauuacacccaauggcagcaucccgaacgacaaaccuuuucagaaugucaaccgcauuacguacggggcuugucccagauauguuaagcagaauacccugaaacuugccacaggaaugcggaacgugccugaaaagcaaacccgcggcaucuucggggcgauugccggauuuaucgagaauggcugggaagggaugguggauggaugguacggcuucagacaccagaacuccgagggcacagggcaggcugccgaccugaaaagcacccaagcugccaucaaucagauuaacggaaagcucaaucggcugaucggcaagacgaacgagaaauuucaccagauugaaaaggaguucucugaagucgaggggagaauccaggaucuugaaaaauauguggaggacacaaagauugaucugugguccuacaaugccgagcuccugguugcucuggaaaaccaacauaccaucgaccucaccgauagcgagaugaacaaacuguucgaacgcacaaagcggcagcuuagagagaaugcggaagacaugggaaacggcugcuuuaagauuuaucacaaaugugauaaugccugcaucgggucuauccgcaacggcaccuacgaccaugacguguaccgggaugaggcucugaauaacagauuccagauuaagggagucgagcucaaauccggcuauaaggacuggauccuguggauuagcuuugccaucuccugcuuccuucuguguguggcccuccugggguuuauuaugugggcuugccagaaaggaaauauccgcuguaacaucugcauuuga

SEQ ID NO: 184333 - RNA, 1701 nt, Artificial Sequence
  derived and/or modified sequence opt5 from hemagglutinin__InfluenzaA__ABI92665
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcgggucuaauaaguccuuuuucagcagacugaacuggcucacacaucugaaauauaaguacccugcccuuaaugucaccaugcccaacaaugagaaauuugauaagcuguauaucuggggagugcaccauccuggcacggacucugaucagauuucccucuacgcgcaggccagcgggcggaucacaguuuccaccaaacgcucucaacagacagugauuccgaacaucggaagcagaccccggguccgcgacguguccagcagaauuucuaucuacuggaccaucgugaagccuggcgacauucugcugaucaacuccaccgggaaucucauugcuccccggggauauuucaagauccgcagcggcaaaucuagcauuaugagauccgaugccccuaucggcaaguguaacucugagugcaucacacccaaugggagcauuccgaacgacaaaccuuuucagaaugucaaccggaucacguacggagcuuguccccgcuauguuaagcagaauacccugaaacuugccacaggcaugagaaacgugccugaaaagcaaacccgggggauuuucggagcgaucgccggcuuuauugagaaugggugggaaggaaugguggauggcugguacggcuuccgccaccagaacuccgaggggacaggacaggcugccgaccugaaaagcacccaagcugccaucaaucagaucaacggcaagcucaauagacugauugggaagacgaacgagaaauuucaccagaucgaaaaggaguucucugaagucgagggacggauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagcgccagcuucgggagaaugcggaagacaugggcaacgggugcuuuaagaucuaucacaaaugugauaaugccugcauuggcucuaucagaaacggaaccuacgaccaugacguguaccgcaaugaggcucugaacaaucgguuccagaucaagggcgucgagcucaaauccggguauaaggauuggauucuguggaucagcuuugccauuuccugcuuccuucuguguguggcccuccugggauuuaucaugugggcuugccagaaaggcaacauuagauguaauaucugcaucuga

SEQ ID NO: 184334 - RNA, 1701 nt, Artificial Sequence
  derived and/or modified sequence opt5 from hemagglutinin__InfluenzaA__ABI92676
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaaacggaaaaagcucuauuaugcggagcgaugccccuaucggcaaguguaauuccgagugcaucacacccaacggcucuauuccgaaugacaaaccuuuucagaacgucaaucgcaucacguauggggcuugucccagauacguuaagcagaacacccugaaacuugccacaggaaugcggaaugugccugaaaagcaaacccgcggcauuuucggggcgaucgccggauuuauugagaacggcugggaagggaugguggauggaugguauggcuucagacaccagaauagcgagggcacagggcaggcugccgaccugaaauccacccaagcugccaucaaccagaucaauggaaagcucaaccggcugauuggcaagacgaaugagaaauuucaucagaucgaaaaggaguucagcgaagucgaggggcgcauucaggaucuugaaaaauacguggaggacacaaagaucgaucuguggucuuauaacgccgagcuccugguugcucuggaaaaccaacacaccauugaccucaccgauuccgagaugaauaaacuguucgaaagaacaaagaagcagcuucgggagaacgcggaagacaugggaaauggcugcuuuaaaaucuaccauaagugugauaacgccugcauugggagcaucagaaauggcaccuaugaccacgacguguaccgcgaugaggcucugaacaaucgguuccagaucaaaggagucgagcucaagucuggcuacaaagacuggauucuguggaucuccuuugccauuagcugcuuccuucuguguguggcccuccugggguuuaucaugugggcuugccagaagggaaacauuagauguaauaucugcaucuga

SEQ ID NO: 184335 - RNA, 1701 nt, Artificial Sequence
  derived and/or modified sequence opt5 from hemagglutinin__InfluenzaA__ABI92687
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcgggucuaauaaguccuuuuucagcagacugaacuggcucacacaucugaaauauaaguacccugcccuuaaugucaccaugcccaacaaugagaaauuugauaagcuguauaucuggggagugcaccauccuggcacggacucugaucagauuucccucuacgcgcaggccagcgggcggaucacaguuuccaccaaacgcucucaacagacagugauuccgaacaucggaagcagaccccggguccgcgacguguccagcagaauuucuaucuacuggaccaucgugaagccuggcgacauucugcugaucaacuccaccgggaaucucauugcuccccggggauauuucaagauccgcagcggcaaaucuagcauuaugagauccgaugccccuaucggcaaguguaacucugagugcaucacacccaaugggagcauuccgaacgacaaaccuuuucagaaugucaaccggaucacguacggagcuuguccccgcuauguuaagcagaauacccugaaacuugccacaggcaugagaaacgugccugaaaagcaaacccgggggauuuucggagcgaucgccggcuuuauugagaaugggugggaaggaaugguggauggcugguacggcuuccgccaccagaacuccgaggggacaggacaggcugccgaccugaaaagcacccaagcugccaucaaucagaucaacggcaagcucaauagacugauugggaagacgaacgagaaauuucaccagaucgaaaaggaguucucugaagucgagggacggauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagcgccagcuucgggagaaugcggaagacaugggcaacgggugcuuuaagaucuaucacaaaugugauaaugccugcauuggcucuaucagaaacggaaccuacgaccaugacguguaccgcgaugaggcucugaauaaccgguuccagaucaagggcgucgagcucaaauccggguauaaggacuggauucuguggaucagcuuugccauuuccugcuuccuucuguguguggcccuccugggauuuaucaugugggcuugccagaaaggcaauauuagauguaacaucugcaucuga

SEQ ID NO: 184336 - RNA, 1701 nt, Artificial Sequence; identical to SEQ ID NO: 184335
  derived and/or modified sequence opt5 from hemagglutinin__InfluenzaA__ABI92698

SEQ ID NO: 184337 - RNA, 1701 nt, Artificial Sequence; identical to SEQ ID NO: 183540
  derived and/or modified sequence opt5 from hemagglutinin__InfluenzaA__ABI92709

SEQ ID NO: 184338 - RNA, 1701 nt, Artificial Sequence
  derived and/or modified sequence opt5 from hemagglutinin__InfluenzaA__ABI92720
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggagucugaccagauuucccucuaugcgcaggccagcggccgcaucacaguuuccaccaaaagaucucaacagacagugauuccgaacaucgggagccggccccgcgucagagauguguccagccggauuucuaucuacuggaccaucgugaagccuggagacauucugcugaucaacuccaccggcaaucucauugcuccccgcggguacuucaagaucagaagcggaaaaucuagcauuaugcgguccgacgccccuaucggcaaguguaacucugaaugcaucacacccaauggcagcauuccgaacgauaaaccuuuucagaaugucaaccgcaucacguauggggcuugucccagauacguuaagcagaauacccugaaacuugccacaggaaugcggaacgugccugagaagcaaacccgcggcauuuucggggcgaucgccggauuuauugaaaauggcugggaggggaugguggacggaugguauggcuucagacaccagaacuccgagggcacagggcaggcugccgaucugaaaagcacccaagcugccaucaaucagaucaacggaaagcucaaucggcugauuggcaagacgaacgaaaaauuucaucagaucgagaaggaguucucugaagucgaagggcgcauucaggaccuugagaaauacguggaggauacaaagaucgaccugugguccuauaaugccgaacuccugguugcucuggagaaccaacacaccauugaucucaccgacagcgaaaugaacaaacuguucgagagaacaaagaagcagcuucgggaaaaugcggaggauaugggaaacggcugcuuuaaaaucuaccauaagugugacaaugccugcauugggucuaucagaaacggcaccuaugaucacgacguguaccgcgacgaggcucugaauaaccgguuccagaucaaaggagucgaacucaaguccggcuacaaagauuggauucuguggaucagcuuugccauuuccugcuuccuucuguguguggcccuccugggguuuaucaugugggcuugccagaagggaaauauuagauguaacaucugcaucuga

SEQ ID NO: 184339 - RNA, 1701 nt, Artificial Sequence
  derived and/or modified sequence opt5 from hemagglutinin__InfluenzaA__ABI92731
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagcggcagcuuagagagaaugcggaagacaugggaaacggcugcuuuaagaucuaucacaaaugugauaaugccugcauugggucuauccgcaacggcaccuacgaccaugacguguaccgggaugaggcucugaauaacagauuccagaucaagggagucgagcucaaauccggcuauaaggacuggauucuguggaucagcuuugccauuuccugcuuccuucuguguguggcccuccugggguuuaucaugugggcuugccagaaaggaaauauucgcuguaacaucugcaucuga

SEQ ID NO: 184340 - RNA, 1701 nt, Artificial Sequence
  derived and/or modified sequence opt5 from hemagglutinin__InfluenzaA__ABI92742
augaagaccaucauugcccugagcuacauccucugccugguguucucccagaaacuucccggcaacgacaauucuacagcuacgcugugucucgggcaccaugccgucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgaucaugccagccuccggucccugguugcuagcucuggaacgcuugaguuuaacaaugaauccuucgacuggaccggcgugacacagaacggcaccagcucugccugcaagcgcagauccaauaagagcuuuuucucucggcugaacuggcucacacaccugaaauacaaguauccugcucuuaaugucaccaugcccaacaaugagaaauuugauaagcuguacaucuggggagugcaucacccugggacggacuccgaucagauuagccucuaugcccaggcguccggccgcaucacaguuucuaccaaaagaagccaacagacagugauuccgaacaucgggucccggccccgcgucagagacgugagcucucggauuuccaucuacuggaccaucgugaagccuggagacauucugcugaucaacagcaccggcaaucucauugcccccagaggguacuucaagaucagaucuggaaaaagcuccauuaugcggucugaugcuccuaucggcaaguguaacagcgagugcaucacacccaauggcuccauuccgaacgacaaaccuuuucagaaugucaaccgcaucacguauggggccugucccagauacguuaagcagaauacccugaaacuugcuacaggaaugcggaacgugccugaaaagcaaacccgcggcauuuucggggccaucgcgggauuuauugagaauggcugggaagggaugguggauggaugguauggcuucagacaccagaacagcgagggcacagggcaggccgcugaccugaaaucuacccaagccgcuaucaaucagaucaacggaaagcucaaucggcugauuggcaagacgaacgagaaauuucaucagaucgaaaaggaguucuccgaagucgaggggcgcauucaggaucuugaaaaauacguggaggacacaaagaucgaucuguggagcuauaaugccgagcuccugguugcccuggaaaaccaacacaccauugaccucaccgauucugagaugaacaaacuguucgaacgcacaaagaagcagcuucgggagaaugcugaagacaugggaaacggcugcuuuaaaaucuaccauaagugugauaaugcgugcauuggguccaucagaaacggcaccuaugaccacgacguguaccgcgaugaggcccugaauaaccgguuccagaucaaaggagucgagcucaagagcggcuacaaagacuggauucuguggaucuccuuugcuauuucuugcuuccuucuguguguggcccuccugggguuuaucaugugggccugccagaagggaaauauuagauguaacaucugcaucuga

SEQ ID NO: 184341 - RNA, 1701 nt, Artificial Sequence
  derived and/or modified sequence opt5 from hemagglutinin__InfluenzaA__ABI92753
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuuaucuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauacaaguauccugcccuuaaugucaccaugcccaacaaugagaaauuugauaagcuguacaucuggggagugcaccauccugggacggacagcgaucagauuucucucuacgcgcaggccuccggccgcaucacaguuagcaccaaaagaucccaacagacagugauuccgaacaucgggucucggccccgcgucagagacgugagcucccggauuagcaucuauuggaccaucgugaagccuggagacauucugcugaucaacucuaccggcaaucucauugcuccccgcggguacuucaagaucagauccggaaaaagcucuauuaugcggagcgaugccccuaucggcaaguguaacuccgagugcaucacacccaauggcucuauuccgaacgacaaaccuuuucagaaugucaaccgcaucacguauggggcuugucccagauacguuaagcagaauacccugaaacuugccacaggaaugcggaacgugccugaaaagcaaacccgcggcauuuucggggcgaucgccggauuuauugagaauggcugggaagggaugguggauggaugguauggcuucagacaccagaacagcgagggcacagggcaggcugccgaccugaaauccacccaagcugccaucaaucagaucaacggaaagcucaaucggcugauuggcaagacgaacgagaaauuucaccagaucgaaaaggaguucagcgaagucgaggggcgcauucaggaucuugaaaaauacguggaggacacaaagaucgaucuguggucuuauaaugccgagcuccugguugcucuggaaaaccaacauaccauugaccucaccgauuccgagaugaacaaacuguucgaaagaacaaagcggcagcuuagagagaaugcggaagacaugggaaacggcugcuuuaagaucuaccacaaaugugauaaugccugcauugggagcauccgcaacggcaccuacgaccaugacguguaucgggaugaggcucugaauaacagauuccagaucaagggagucgagcucaaaucuggcuacaaggacuggauucuguggaucuccuuugccauuagcugcuuccuucuguguguggcccuccugggguuuaucaugugggcuugccagaaaggaaauauucgcuguaacaucugcaucuga

SEQ ID NO: 184342 - RNA, 1701 nt, Artificial Sequence
  derived and/or modified sequence opt5 from hemagglutinin__InfluenzaA__ABI92764
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucgacuggaccggagugacacagaacggcaccuccagcgcuugcaagcgcggcucuaauaaguccuuuuucagcagacugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccggaucacaguuuccaccaaacgcucucaacagacagugauuccgaacaucgggagcagaccccggguccgcgacguguccagcagaauuucuaucuacuggaccaucgugaagccuggagacauucugcugaucaacuccaccggcaaucucauugcuccccggggguauuucaagauccgcagcggaaaaucuagcauuaugagauccgaugccccuaucggcaaguguaacucugaaugcaucacacccaauggcagcauuccgaacgacaaaccuuuucagaaugucaaccggaucacguacggggcuuguccccgcuauguuaagcagaauacccugaaacuugccacaggaaugagaaacgugccugagaagcaaacccggggcauuuucggggcgaucgccggauuuauugaaaauggcugggaggggaugguggauggaugguacggcuuccgccaccagaacuccgagggcacagggcaggcugccgaccugaaaagcacccaagcugccaucaaucagaucaacggaaagcucaauagacugauuggcaagacgaacgaaaaauuucaccagaucgagaaggaguucucugaagucgaagggcggauucaggaucuugagaaauauguggaggacacaaagaucgaucugugguccuacaaugccgaacuccugguugcucuggagaaccaacauaccauugaccucaccgauagcgaaaugaacaaacuguucgagagaacaaagcgccagcuucgggaaaaugcggaggacaugggaaacggcugcuuuaagaucuaucacaaaugugauaaugccugcauugggucuaucagaaacggcaccuacgaccaugacguguaccgcgaugaggcucugaauaaccgguuccagaucaagggagucgaacucaaauccggcuauaaggacuggauucuguggaucagcuuugccauuuccugcuuccuucuguguguggcccuccugggguuuaucaugugggcuugccagaaaggaaauauuagauguaacaucugcaucuga

SEQ ID NO: 184343 - RNA, 1701 nt, Artificial Sequence; identical to SEQ ID NO: 184335
  derived and/or modified sequence opt5 from hemagglutinin__InfluenzaA__ABI92775

SEQ ID NO: 184344 - RNA, 1701 nt, Artificial Sequence; identical to SEQ ID NO: 183267
  derived and/or modified sequence opt5 from hemagglutinin__InfluenzaA__ABI92786

SEQ ID NO: 184345 - RNA, 1701 nt, Artificial Sequence
  derived and/or modified sequence opt5 from hemagglutinin__InfluenzaA__ABI92797
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuucuaacaucgggagccggccgcgcgucagagauauucccucccggaucagcaucuacuggaccauugugaaaccuggagacauccugcugauuaauucuaccggcaaccucaucgcuccccgcggguacuuuaagauuagauccggaaagagcucuaucaugcggagcgacgccccuaucggcaaauguaauuccgagugcauuacacccaacggcucuaucccgaaugauaagccuuuccagaacgugaaucgcauuacguauggggcuugucccagauacgucaaacagaacacccugaaacuugccacaggaaugcggaauguuccugaaaagcaaacccgcggcaucuuuggggcgauugccggauucaucgagaacggcugggaagggaugguggacggaugguauggcuuuagacaccagaauagcgagggcaucgggcaggcugccgaucugaaguccacacaagcugccauuaaccagaucaauggaaaacucaaccggcugauuggcaagaccaacgagaaguuccaccagaucgaaaaagaguucagcgaaguggaggggcgcauucaggaccuugaaaaguacgucgaggauacgaaaaucgaccuguggucuuauaaugccgagcuccugguggcucuggaaaaccaacauacaauugaucucaccgacuccgagaugaauaagcuguuugaaagaaccaaaaagcagcuucgggagaacgcggaagauaugggaaauggcugcuucaagaucuaccacaaaugugacaacgccugcaucgggagcauuagaaauggcacauaugaucaugacguuuaccgcgacgaggcucugaacaaucgguuucagaucaagggaguggagcucaaaucuggcuacaaggauuggauucuguggaucuccuucgccauuagcugcuuucuucugugugucgcccuccugggguucaucaugugggcuugccagaaaggaaacaucagauguaauauuugcaucuga

SEQ ID NO: 184346 - RNA, 1701 nt, Artificial Sequence; identical to SEQ ID NO: 183267
  derived and/or modified sequence opt5 from hemagglutinin__InfluenzaA__ABI92808

SEQ ID NO: 184347 - RNA, 1701 nt, Artificial Sequence; identical to SEQ ID NO: 183267
  derived and/or modified sequence opt5 from hemagglutinin__InfluenzaA__ABI92819

SEQ ID NO: 184348 - RNA, 1701 nt, Artificial Sequence; identical to SEQ ID NO: 183267
  derived and/or modified sequence opt5 from hemagglutinin__InfluenzaA__ABI92841

SEQ ID NO: 184349 - RNA, 1701 nt, Artificial Sequence
  derived and/or modified sequence opt5 from hemagglutinin__InfluenzaA__ABI92852
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucggguaccggccccgcgucagagauauuccuucucggaucagcaucuacuggaccauugugaaacccggagacauccugcugauuaauuccaccggcaaccucaucgcuccucgcggguauuuuaagauuagaagcggaaagucuuccaucaugcggagcgacgcccccaucggcaaauguaauucugagugcauuacaccgaacggcagcaucccuaaugauaagcccuuccagaacgugaaucgcauuacguacggggcuuguccuagauaugucaaacagaacacccugaaacuugccacaggaaugcggaauguucccgaaaagcaaacccgcggcaucuuuggggcgauugccggauucaucgagaacggcugggaagggaugguggacggaugguacggcuuuagacaccaaaauuccgagggcaucgggcaggcugccgaucugaagucuacacaggcugccauuaaccagaucaauggaaaacucaaccggcugauuggcaagaccaacgagaaguuccaccagaucgaaaaagaguucagcgaaguggaggggcgcauucaggaccuugaaaaguaugucgaggauacgaaaaucgaccugugguccuacaaugccgagcuccugguggcucuggaaaaccaacauacaauugaucucaccgacagcgagaugaauaagcuguuugaaagaaccaaaaagcagcuucgggagaacgcggaagauaugggaaauggcugcuucaagaucuaucacaaaugugacaacgccugcaucgggucuauuagaaauggcacauacgaucaugacguuuaccgcgacgaggcucugaacaaucgguuucagaucaagggaguggagcucaaauccggcuauaaggauuggauucuguggaucagcuucgccauuucuugcuuucuucugugugucgcccuccugggguucaucaugugggcuugccagaaaggaaacaucagauguaauauuugcaucuga

SEQ ID NO: 184350 - RNA, 1701 nt, Artificial Sequence
  derived and/or modified sequence opt5 from hemagglutinin__InfluenzaA__ABI92863
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagcccauuccaauuguuauccuuacgacgugcccgauuaugcuucucuccggagccugaucgccuccagcggaacgcuugaguuuaacaaugaaucuuucaacuggaccggcguuacacagaauggcaccuccagcgcuugcaagcgcagaucuaaccaguccuuuuucagccggcugaauuggcucacacaccugaaguuuaaauacccugcccuuaacgugaccaugcccaauaacgagaaguucgacaaacuguauauuuggggaguccaucacccugggacggauucugaccagaucucccucuacgcgcaagccccgggccgcauuacagugagcaccaagagaucccagcagacaguuauccccaacauugggucucggccucgcgugagagauaucagcucccggaucagcauuuauuggaccaucgucaaacccggagacauucugcugaucaauucuaccggcaaccucauugcuccucgcggguacuuuaagaucagauccggaaagagcucuaucaugaaaagcgacgcccccauuggccgguguaauuccgagugcaucacaccgaacggcucuauuccuaaugauaagcccuuccagaacgugaaucgcaucacguacggggcuuguccuagauaugugaaacaaaacacccugaaacuugccacaggaaugcggaauguccccgaaaaacagacccgcggcauuuuuggggcgaucgccggauucaucgagaacggcugggaagggaugguugacggaugguacggcuuuagacaccagaauagcgagggcacagggcaagcugccgaucugaaguccacccaggcugccauuaaccagaucaauggaaaacucaaccggcugauuggcaagacgaaugagaaguuccaucagaucgaaaaagaguucagcgaaguggaggggcgcauucaagaccuugaaaaguauguggaggauacaaaaaucgaccuguggucuuacaacgccgagcuccuggucgcucuggaaaaccagcacaccauugaucucaccgacuccgagaugaauaagcuguuugaaagaacaaagaagcagcuucgggagaacgcggaagauaugggaaauggcugcuucaagaucuaucauaaaugugacaacgccugcaucgggagcauuagaaauggcaccuacgaucacgacguguaucgcgacgaggcucugaacaaucgguuucagaucaagggaguugagcucaaaucuggcuacaaggauuggauucuguggaucuccuucgccauuagcugccuucugcucuguguggcccugcugggguuuaucaugugggcuugccaaaaaggaaacaucagauguaauauuugcaucuga

SEQ ID NO: 184351 - RNA, 1701 nt, Artificial Sequence; identical to SEQ ID NO: 183267
  derived and/or modified sequence opt5 from hemagglutinin__InfluenzaA__ABI92874

SEQ ID NO: 184352 - RNA, 1701 nt, Artificial Sequence; identical to SEQ ID NO: 183267
  derived and/or modified sequence opt5 from hemagglutinin__InfluenzaA__ABI92885

SEQ ID NO: 184353 - RNA, 1701 nt, Artificial Sequence
  derived and/or modified sequence opt5 from hemagglutinin__InfluenzaA__ABI92907
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccguaucagauccuugauggagagaauuguacccugauugacgcccuccugggcgauccccagugcgacggguuucaaaacaaaaagugggaucuguucgucgaaagaagcaaagccuacuccaauuguuauccuuacgacgugcccgauuauguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaccugaaguuuaaauacccugcucuuaaugugaccaugcccaacaacgagaaguucgacaaacuguauaucuggggaguucaucacccugggacggauaaugaccagauuucucucuacgcccaggcguccggccgcaucacagugagcaccaagagaucccaacagacagucauuccgaacaucgggucucggccccgcgugagagauauuccuagccggaucuccaucuacuggaccauugugaaacccggagacauccugcugauuaauagcaccggcaaccucaucgccccucgcggguauuuuaagauuagaucuggaaaguccagcaucaugcggucugacgcucccaucggcaaauguaauagcgagugcauuacaccgaacggcuccaucccuaaugauaagcccuuccagaacgucaaucgcauuacguacggggccuguccuagauauguuaaacagaacacccugaagcuggcuacaggaaugcggaaugugcccgaaaaacaaacccgcggcaucuuuggggccauugcgggauucaucgagaacggcugggaagggaugguggacggaugguacggcuuuagacaucaaaauucugagggcaucgggcaggccgcugaucuuaagagcacacaggccgcuauuaaccagaucaauggaaaacucaaccggcugauuggcaagaccaacgagaaguuccaccagaucgaaaaagaguucuccgaagucgaggggcgcauucaggaccuugaaaaguauguggaggauacgaaaaucgaccuguggagcuacaaugccgagcuccugguugcccuggaaaaccaacacacaauugaucucaccgacucugagaugaauaagcuguuugaaagaaccaaaaagcagcuucgggagaacgcugaagauaugggaaauggcugcuucaagaucuaucauaaaugugacaacgcgugcaucggguccauuagaaauggcacauacgaucacgacguguaccgcgacgaggcccugaacaaucgguuucagaucaagggagucgagcucaaaagcggcuauaaggauuggauucuguggaucucuuucgcuauuuccugcuuucuucuguguguggcccuccugggguucaucaugugggccugccagaaaggaaacaucagauguaauauuugcaucuga

SEQ ID NO: 184354 - RNA, 1701 nt, Artificial Sequence; identical to SEQ ID NO: 183267
  derived and/or modified sequence opt5 from hemagglutinin__InfluenzaA__ABI92918

SEQ ID NO: 184355 - RNA, 1701 nt, Artificial Sequence; identical to SEQ ID NO: 184353
  derived and/or modified sequence opt5 from hemagglutinin__InfluenzaA__ABI92929

SEQ ID NO: 184356 - RNA, 1701 nt, Artificial Sequence
  derived and/or modified sequence opt5 from hemagglutinin__InfluenzaA__ABI92940
augaagaccaucauugccuucaacuacauccugugccucguguuugcucagaaacugcccggcaaugacaacagcacagccacgcuuugucuggggcaccaugcggucccuaauggaaccauuguuaagacaaucaccaacgaucaaauugaggugacaaaugcuaccgaacucgugcaguccucuagcacaggcgggaucugcgacuccccgcaccagauccuggauggagagaacuguacccuuauugacgcccugcucggcgauccccagugcgacggguuccaaaauaaaaagugggaucuguuugucgaaagaucuaaagccuauagcaacuguuacccuuaugacgugcccgauuacgcuucccugcggucucucguugccagcuccggaacgcuggaguucaauaacgaaaucuuuaauuggaccggcgugacacagaacggcaccagcucugcuugcaagcgcagauccaauaacagcuucuuuucucggcuuaauuggcugacacaucucaaguucaaauauccugcccugaacgucaccaugcccaacaaugagaaguuugacaaacuuuacauuuggggagugcaccauccugggacggauaacgaccagaucucccuguaugcgcaggccagcggccgcauuacaguuucuaccaagagaucccaacagacagugaucccgaauauugggagccggccccgcgucagagauaucccuucccggaucucuauuuacuggaccaucgugaaacccggagacauucuccugaucaacagcaccggcaaucugauugcuccucgcggguacuucaagaucagauccggaaagagcucuaucaugcgguccgacgcccccauuggcaaauguaacagcgagugcaucacaccgaauggcucuauuccuaacgauaagcccuuucagaaugugaaccgcaucacguauggggcuuguccuagauacgucaaacagaauacccucaagcuggccacaggaaugcggaacguucccgaaaaacaaacccgcggcauuuucggggcgaucgccggauuuaucgagaauggcugggaagggaugguggacggaugguauggcuucagacaccagaacagcgagggcacagggcaggcugccgaucuuaaguccacccaagcugccauuaaucagaucaacggaaaacugaaccggcucauuggcaagacgaaugagaaguuccaccagaucgaaaaagaguuuucugaaguggaggggcgcauucaggaccuggaaaaguacgucgaggauacaaaaaucgaccuuuggagcuauaacgccgagcugcucguggcucuggaaaaucaacauaccauugaucugaccgacuccgagaugaacaaacucuucgaaagaacaaagaagcagcugcgggagaaugcggaagauaugggaaacggcugcuuuaagaucuaccacaaaugugacaaugccugcaucgggagcauuagaaacggcaccuaugaucaugacguuuaccgcgacgaggcucuuaauaaccgguuccagaucaagggaguggagcugaaaucuggcuacaaggauuggauucucuggaucuccuuugccauuagcugcuuccugcuuugugucgcccugcucggguuuaucaugugggcuugccagaaaggaaauaucagauguaacauuugcaucuga

SEQ ID NO: 184357 - RNA, 1701 nt, Artificial Sequence
  derived and/or modified sequence opt5 from hemagglutinin__InfluenzaA__ABI92951
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcaccaagaaacagcuucgggaaaacgcggaggauaugggaaauggcugcuucaagaucuaucacaagugugacaacagcugcauugggucuaucagaaauggcacauacgaucaugacguguaccgcgacgaggcccugaacaaucgguuucagauuaaaggaguugaacucaaguccggcuauaaagauuggauccuguggauuagcuucgcuaucuccugcuuucuucuguguguggcccuccugggguucaucaugugggccugccagaagggaaacauuagauguaauaucugcauuuga

SEQ ID NO: 184358 - RNA, 1701 nt, Artificial Sequence
  derived and/or modified sequence opt5 from hemagglutinin__InfluenzaA__ABI92962
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaaauaaagccuauagcaacuguuacccuuaugacgugcccgauuacgcuucccuccggucucugaucgccagcuccggaacgcuugaguuuaauaacgaaucuuucaauuggaccggcguuacacagaacggcaccucuuccgcuugcaagcgcagaagcaauucuuccuuuuucagccggcugaacuggcucacacaucugaaguuuaaauauccugcccuuaaugugaccaugcccaacaacgaggaguucgacaagcuguacauuuggggaguccaccauccugggacguauaaugaucagaucucucucuacgcgcaggccuccggccgcauuacagugagcaccaaaagaucccaacagacaguuaucccgaacauugggucucggccccgcgugagagacaucccuagccggaucuccauuuacuggaccaucgucaagcccggagauauucugcugaucaauagcaccggcaaccucauugcuccucgcggguauuuuaaaaucagaucuggaaaguccagcaucaugcggucugacgcccccauuggcaaguguaauagcgaaugcaucacaccgaacggcuccauuccuaaugacaaacccuuccagaacgugaaucgcaucacguacggggcuuguccuagauaugugaagcagaacacccugaaacuugccacaggaaugcggaauguccccgagaagcaaacccgcggcauuuuuggggcgaucgccggauucaucgaaaacggcugggaggggaugguugauggaugguacggcuuuagacaccagaauagcgagggcauugggcaggcugccgaccugaaaagcacacaagcugccaucgaucagauuaacggaaagcucaaucggcugaucggcaaaaccaacgaaaaguuccaccagauugagaaggaguucuccgaaguggaagggagaauccaggaccuugagaaauauguggaggauacgaagauugaccuguggagcuacaacgccgaacuccuggucgcucuggagaaucaacauacaaucgaucucaccgacucugaaaugaacaaacuguuugagcgcaccaagaaacagcuucgggaaaaugcggaggauaugggaaacggcugcuucaagaucuaucacaagugugacaaugccugcauuggguccaucagaaacggcacauacgaucaugacguguaccgcgacgaggcucugaauaaccgguuucagauuaaaggaguugaacucaagagcggcuauaaagauuggauccuguggauuucuuucgccaucuccugcuuucuucuguguguggcccuccugggguucaucaugugggcuugccagaagggaaauauuagauguaacaucugcauuuga

SEQ ID NO: 184359 - RNA, 1701 nt, Artificial Sequence; identical to SEQ ID NO: 183657
  derived and/or modified sequence opt5 from hemagglutinin__InfluenzaA__ABI92973

SEQ ID NO: 184360 - RNA, 1701 nt, Artificial Sequence; identical to SEQ ID NO: 183657
  derived and/or modified sequence opt5 from hemagglutinin__InfluenzaA__ABI92984

SEQ ID NO: 184361 - RNA, 1701 nt, Artificial Sequence
  derived and/or modified sequence opt5 from hemagglutinin__InfluenzaA__ABI92995
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcaucagagacaucccuucccggauuagcaucuacuggaccauugugaagcccggagauauccugcugauuaacucuaccggcaaucucaucgcuccucgcggguauuuuaaaaucagauccggaaagagcucuauuaugcggagcgacgcccccaucggcaaguguaacuccgaaugcauuacaccgaauggcucuaucccuaacgacaaacccuuccagaaugucaaccgcauuacguacggggcuuguccuaaguaugugaaacagaauacccugaaacuugccacaggaaugagaaacgugcccgagaagcaaacccggggcaucuuuggggcgaucgccggauucauugaaaauggcugggaggggauggucgauggaugguacggcuuucgccaccagaacagcgagggcaucgggcaggcugccgaccugaaguccacacaagcugccauugaucagaucaauggaaaacucaacagacugauuggcaagaccaaugaaaaguuccaccagaucgagaaagaguucagcgaaguugaagggcggauucaggaccuugagaaguauguggaggauacgaaaaucgaccuguggucuuacaacgccgaacuccugguggcucuggagaaccaacauacaaucgaucucaccgacuccgaaaugaauaagcuguuugagagaaccaaaaagcagcuucgcgaaaacgcggaggauaugggaaauggcugcuucaagauuuaucacaaaugugacaacgccugcaucgggagcauucggaauggcacauacgaucaugacgucuacagagacgaggcucugaacaaucgcuuucagaucaagggaguggaacucaaaucuggcuauaaggauuggauucuguggaucuccuucgccaucagcugcuuucuucuguguguugcccuccugggguucauuaugugggcuugccagaaaggaaacauccgguguaauauuugcaucuga

SEQ ID NO: 184362 - RNA, 1701 nt, Artificial Sequence; identical to SEQ ID NO: 183657
  derived and/or modified sequence opt5 from hemagglutinin__InfluenzaA__ABI93006

SEQ ID NO: 184363 - RNA, 1701 nt, Artificial Sequence; identical to SEQ ID NO: 183657
  derived and/or modified sequence opt5 from hemagglutinin__InfluenzaA__ABI93017

SEQ ID NO: 184364 - RNA, 1698 nt, Artificial Sequence; identical to SEQ ID NO: 184256
  derived and/or modified sequence opt5 from hemagglutinin__InfluenzaA__ABI93028

SEQ ID NO: 184365 - RNA, 1701 nt, Artificial Sequence; identical to SEQ ID NO: 183990
  derived and/or modified sequence opt5 from hemagglutinin__InfluenzaA__ABI93039

SEQ ID NO: 184366 - RNA, 1701 nt, Artificial Sequence
  derived and/or modified sequence opt5 from hemagglutinin__InfluenzaA__ABI93061
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucugggaagucuuccauuaugcggucugacgcuagcaucggaaaauguaauuccgaaugcauuaccccuaacggcagcauccccaaugacaagccguuucagaacguuaaucgcaucaccuacggcgccuguccuagauaugugaaacagaacacacuuaagcuggcgacggggaugcggaaugugcccgagaaacaaacccgcggaauuuucggcgccaucgcuggguuuauugaaaacggaugggagggcauggucgaugggugguacggauucagacaccagaauagcgagggcacaggccaggccgcugaccucaaguccacccaagccgccaucaaccagauuaaugggaaacugaaccggcuuaucgaaaagacaaaugagaaguuucaucagaucgaaaaagaguucagcgaaguggagggacgcauucaggaucuggagaaguauguugaagacaccaaaaucgaucucuggucuuacaacgcugagcugcugguggcgcucgaaaaccaacacacgauugaccugacagauuccgagaugaauaaacuuuucgaacgcaccaagaagcagcugcgggagaacgccgaggacaugggcaaugggugcuuuaagaucuaucauaaaugugauaacgcuugcauuggaagcaucagaaauggcaccuacgaccacgaugucuaccgcgacgaagcccucaacaaucgguuccagauuaaggggguggagcugaaauccggcuauaaggacuggauccuuuggaucucuuuugccauuagcugcuuccugcucuguguugugcugcugggauuuaucaugugggcuugccagaaaggcaacauuagauguaauaucugcauuuga

SEQ ID NO: 184367 - RNA, 1701 nt, Artificial Sequence; identical to SEQ ID NO: 183674
  derived and/or modified sequence opt5 from hemagglutinin__InfluenzaA__ABI93072

SEQ ID NO: 184368 - RNA, 1701 nt, Artificial Sequence; identical to SEQ ID NO: 183674
  derived and/or modified sequence opt5 from hemagglutinin__InfluenzaA__ABI93083

SEQ ID NO: 184369 - RNA, 1701 nt, Artificial Sequence; identical to SEQ ID NO: 183674
  derived and/or modified sequence opt5 from hemagglutinin__InfluenzaA__ABI93094

SEQ ID NO: 184370 - RNA, 1701 nt, Artificial Sequence; identical to SEQ ID NO: 183674
  derived and/or modified sequence opt5 from hemagglutinin__InfluenzaA__ABI93105

SEQ ID NO: 184371 - RNA, 1701 nt, Artificial Sequence
  derived and/or modified sequence opt5 from hemagglutinin__InfluenzaA__ABI93116
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagaugcgcuccggaaagagcucuaucaugagaagcgacgcuuccauuggcaaaugcaauucugaauguaucacccccaacggcagcauuccgaaugacaagccuuuucagaacguuaaucggaucaccuacggggccugcccccgcuaugugaaacagaacacacuuaagcuggcgacgggaaugagaaaugugccugagaaacaaacccggggcaucuucggggccauugcuggauuuaucgaaaacggcugggaggggauggucgauggaugguacggcuuccgccaccaaaauuccgagggcacagggcaggccgcugaccucaagagcacccaggccgccauuaaccagaucaauggaaaacugaacagacuuauugaaaagacaaaugagaaguuucaucagaucgaaaaagaguucucugaaguggagggccggauccaggaucuggagaaguauguugaagacaccaaaauugaucucugguccuacaacgcugagcugcugguggcgcucgaaaaccaacacacgaucgaccugacagauagcgagaugaauaaacuuuucgaaagaaccaagaagcagcugcgcgagaacgccgaggacauggggaauggauguuuuaagauuuaucauaaaugcgauaacgcuugcaucggcucuauucggaaugggaccuacgaccacggcgucuacagagaugaagcccucaacaaucgcuuccagaucaagggaguggagcugaaauccggcuauaaggacuggauucuuuggaucagcuuugccaucuccuguuuccugcucugcguugugcugcugggguuuauuaugugggcuugucagaaaggaaacauccggugcaauauuuguaucuga

SEQ ID NO: 184372 - RNA, 1689 nt, Artificial Sequence
  derived and/or modified sequence opt5 from hemagglutinin__InfluenzaA__ABI94581
augaacacccagauccugguguucgcccucgucgcuagcauucccacaaaugccgacaagaucugccugggccaccaugcgguuuccaacgggacgaaagugaauacccuuacagagagaggaguggaagucgugaacgcuaccgagacaguugaacggaccaaugugccucgcauuuguucuaagggcaaaagaacagucgaucuggggcaaugcggacuccugggcaccaucacggggccgccccagugugaccaguuucuugaguucagcgccgaucugauuaucgaacggcgcgagggauccgacgugugcuacccuggcaaguuuguuaacgaggaagcccucagacagauccugcgggagucuggcgggauugauaaagaaaccaugggauucacauauagcggcauccgcaccaaugggacaaccuccgcuuguagacggucuggaagcuccuuuuacgccgagaugaaguggcugcucagcaacacggacaaugcugccuucccccaaaugacaaagucuuauaaaaacacccgcaaggauccugcgcugauuaucuggggcauucaccauuccgggagcacaaccgagcagaccaaacuuuacggaucuggcaauaagcugaucacagugggcuccagcaacuaucagcagucuuuuguccccuccccuggggccagaccgcaagugaauggacagagcggccggauugacuuccacuggcucauccugaaccccaaugauacggugaccuuuuccuucaacggggcuuuuaucgccccugaccgcgcuucuuuccuuagaggaaaaagcaugggcauucaguccgaaguccagguugaugccaacugcgagggggacuguuaccauagcggaggcacaaucauuucuaaucugcccuuucaaaacaucaauucccgggcggugggcaagugcccucgcuaugugaagcaggaaagccuccugcuggccaccgggaugaaaaacguccccgagauuccgaagagacggagacgcggacucuucggcgcuaucgccggguucaucgaaaauggaugggagggccugauugaugggugguacggcuuucggcaccagaacgcucaaggagagggcacagccgccgacuacaaaucuacccagagcgcuaucgaccagauuacggggaaacuuaauagacugaucgaaaagacaaaccagcaauucgagcucauugauaaugaauuuaccgagguggaaaagcagaucggaaacguuaucaauuggacccgcgacuccaugacagagguguggucuuauaacgcggagcugcuugucgccauggaaaaucagcacaccauugaucuggcugacagcgagaugaacaaacucuacgaacgggugaagagacagcugcgcgagaaugccgaagaggauggcacaggguguuucgagaucuuucauaagugcgacgaugacuguauggccuccauucggaacaacacguaugaucacagcaaauacagagaagaggcuauccaaaaucgcauucagaucgacccuguuaagcugucuuccggauauaaagaugugauucucugguucagcuuuggcgccucuugcuucauccugcuugcgaucgcuauggggcuggucuuuauuugcgugaagaacggcaauaugcgguguaccaucugcauuuga

SEQ ID NO: 184373 - RNA, 1701 nt, Artificial Sequence; identical to SEQ ID NO: 183790
  derived and/or modified sequence opt5 from hemagglutinin__InfluenzaA__ABI95228

SEQ ID NO: 184374 - RNA, 1701 nt, Artificial Sequence
  derived and/or modified sequence opt5 from hemagglutinin__InfluenzaA__ABI95239
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggauggugaauggaugguauggcuuuagacaccagaacucugagggcaucgggcaggcugccgaccuuaagagcacacaagcugccauuaaucagaucaacggaaaacucaaccggcugauuggcaagaccaaugagaaguuccaccagaucgaaaaagaguucuccgaaguggaggggcgcauucaggaucuugaaaaguacgucgaggacacgaaaaucgaucuguggagcuauaacgccgagcuccugguggcucuggaaaaucaacauacaauugaccucaccgauucugagaugaacaagcuguuugaaagaaccaaaaagcagcuucgggagaaugcggaagacaugggaaacggcugcuucaagaucuaccacaaaugugauaaugccugcaucggguccauuagaaacggcacauaugaccaugauguuuaccgcgacgaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 184375 - RNA, 1698 nt, Artificial Sequence
  derived and/or modified sequence opt5 from hemagglutinin__InfluenzaA__ABI95250
augaaggccaaacugcucgugcugcuuugcaccuucacagcuacguacgccgacaccaucugugucggcuaucacgcgaacaauagcacagauaccguugacacagugcuggagaagaacgugaccgucacacauuccgugaaucuccuggaagauucucacaacgggaaacuuugccugcucaagggaauugcuccccugcagcugggcaauuguagcguugccggguggauccucggaaacccugagugcgaaucccugauuucuaaagagagcugguccuacaucguggaaaccccgaaucccgagaacggcacguguuauccuggguacuuugccgacuaugaggaacuuagagagcaacugucuagcgucuccagcuucgaacgguuugagauuuuccccaaggagucuuccuggccuaaucauaccgugacaggaguuagcgcuucuugcucccacaacggcaagagcucuuuuuaccgcaaucuccuguggcuuaccgagaaaaacggccuguaucccaaucucuccaagagcuacgugaacaauaaagaaaaggaaguccuggugcuguggggagugcaucacccuuccaacaucggggaucagagagccaucuaccacacagagaacgcuuaugucucuguugugagcucccauuacagccggcgcuucaccccggaaauugccaaaagacccaaggugcggggccaggaggggcgcaucaauuauuacuggacgcuccuggagccuggagacacaauuaucuuugaagcgaacggcaaucuuauugcccccugguaugcuuucgcccugucuagaggguuuggauccggcaucauuaccagcaacgcuccuaugaaugagugugaugccaagugccagacaccccaaggcgcgaucaacucuagccucccguuccagaauguccacccugugaccaucggggaaugucccaaauacguucgguccgccaagcugcgcauggugaccggacuuagaaacauuccuucuauccagagccggggccuguuuggggcuauugccggauucaucgagggcggguggacaggaaugauugacggcugguauggcuaccaucaccagaaugaacaaggguccggauacgcugccgaucagaaaagcacgcagaacgccaucaauggcaucaccaacaaggucaauucugugauugagaaaaugaacacacaguuuaccgcuguugggaaggaguucaauaaacucgaacgcagaauggagaaccugaacaagaagguggacgauggauuccuggacaucuggacauauaaugcggaacuccugguccuucuggagaacgaacggacccucgauuuucacgacuccaaugugaaaaaccuguacgagaaggucaaaagccaacuuaagaauaacgccaaagagauuggcaaugggugcuucgaauuuuaucauaaguguaacaaugagugcauggaaucugugaagaacggcacguacgacuaucccaaauacuccgaggagagcaagcugaaucgcgagaaaaucgauggaguuaagcucgaauccaugggcguguaucagauucuggcuaucuacucuacagucgccagcucccuggugcuccugguuucucuuggggccaucagcuucuggaugugcuccaacggaagccugcaguguagaauuugcaucuga

SEQ ID NO: 184376 - RNA, 1698 nt, Artificial Sequence
  derived and/or modified sequence opt5 from hemagglutinin__InfluenzaA__ABI95261
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgagaaaaacggccuguaucccaaucucuccaagagcuacguuaacaauaaagaaaaggaagugcugguccuguggggagugcaucacccuuccaacaucggggugcagagagccauuuaccacacagagaacgcuuaugucucuguugugagcucccauuacagccggcgcuucaccccggaaaucgccaaaagacccaaggugcgggaucaggagggccgcauuaauuauuacuggacgcuccuggagccuggggacacaaucauuuuugaagcgaacggaaaucuuaucgcccccugguaugcuuucgcccugucuagaggcuuugaguccgggauuaucaccagcaacgcuccuaugaaugaaugugaugccaagugccagacaccccaaggagcgaucaacucuagccucccguuccagaauguccacccugugaccauuggcgagugucccaaauacguucgguccgccaagcugcgcauggugaccggccuuagaaacaucccuucuauucagagccgggggcuguuuggagcuaucgccggcuucauugaagggggauggacaggcaugaucgacgggugguauggauaccaucaccagaaugagcaaggcuccggcuacgcugccgaucagaaaagcacgcagaacgccaucaaugggauuaccaacaaggucaauucugugaucgagaaaaugaacacacaguuuaccgcuguuggaaaggaguucaauaaacucgaacgcagaauggaaaaccugaacaagaagguggacgauggcuuccuggacauuuggacauauaaugcggagcuccugguccuucuggaaaacgagcggacccucgauuuucacgacuccaaugugaaaaaccuguacgagaaggucaaaagccaacuuaagaauaacgccaaagaaaucgggaauggaugcuucgaguuuuaucauaaguguaacaaugaaugcauggagucugugaagaacggcacguacgacuaucccaaauacuccgaggaaagcaagcugaaucgcgagaaaauugaugggguuaagcucgaauccaugggcguguaucagauccuggcuaucuacucuacagucgccagcucccuggugcuccugguuucucuuggagccauuagcuucuggaugugcuccaacggcagccugcaguguagaaucugcauuuga

SEQ ID NO: 184377 - RNA, 1698 nt, Artificial Sequence; identical to SEQ ID NO: 184256
  derived and/or modified sequence opt5 from hemagglutinin__InfluenzaA__ABI95272

SEQ ID NO: 184378 - RNA, 1698 nt, Artificial Sequence; identical to SEQ ID NO: 184256
  derived and/or modified sequence opt5 from hemagglutinin__InfluenzaA__ABI95283

SEQ ID NO: 184379 - RNA, 1698 nt, Artificial Sequence; identical to SEQ ID NO: 183320
  derived and/or modified sequence opt5 from hemagglutinin__InfluenzaA__ABI95294

SEQ ID NO: 184380 - RNA, 1698 nt, Artificial Sequence
  derived and/or modified sequence opt5 from hemagglutinin__InfluenzaA__ABI96104
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugauuaagucuuacgccaacaauaaagaaaaggagguucugauccucuggggagugcaucacccuccgaacauuggcgaucagagaacccuguaccacacagaaaacgcuuaugucuccguggugagcucccauuacucucggcgcuucacccccgagaucacgaaaagaccuaagguccgggaccaggaagggcgcauuaauuauuacuggacacuucuggagcccggagauaccaucauuuuugaggccaacggcaaucucaucgcgccuugguaugccuucgcucugagcagaggguuuggauccggcaucauuacaagcaacgcccccauggacgaaugugaugcuaagugccagaccccgcaaggcgccaucaauucuucccuuccuuuccagaacguucaccccgugaccauuggggaguguccuaaauacgugcggagcgcgaagcugcgcauggucacaggacucagaaauauccccucuauucagagccggggccuguuuggggccaucgcuggauucaucgaaggcggguggacgggaaugguggacggcugguauggcuaccaucaccagaacgagcaaggguccggauacgccgcugaucagaaaucuacccagaaugccauuaacggcaucacaaauaagguuaacagcgugauugaaaagaugaauacccaguuuacagccgucgggaaagaguucaacaaacuggagcgcagaauggaaaaucucaacaagaagguggacgauggauuccuggacaucuggaccuauaacgcugagcuucugguucuccuggaaaaugagcggacgcuugacuuucacgauuccaacgugaaaaaucuguacgaaaaggucaaaagccaacucaagaacaaugcgaaagagauuggcaacgggugcuucgaguuuuaucauaaguguaauaacgaaugcauggagucugugaagaauggcacauacgacuaucccaaauacuccgaagagagcaagcugaaccgcgagaaaaucgauggagucaagcuggacucuaugggcguguaucagauccucgccauuuacuccaccguugcuagcucccuggugcuucuggucucucucggggccaucagcuucuggaugugcuccaauggaucucugcaguguagaauuugcaucuga

SEQ ID NO: 184381 - RNA, 1701 nt, Artificial Sequence; identical to SEQ ID NO: 183674
  derived and/or modified sequence opt5 from hemagglutinin__InfluenzaA__ABJ09107

SEQ ID NO: 184382 - RNA, 1701 nt, Artificial Sequence
  derived and/or modified sequence opt5 from hemagglutinin__InfluenzaA__ABJ09140
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcaagucuuauuccugcaagcggggcagcgucaacucuuucuucucccgccucaauuggcugcacaaacuugaguacaaguauccugcccugaacgugacaaugcccaauaacgggaaauuugacaagcucuacaucuggggaguucaucacccuagcaccgauucugaccaaacaucccuguacgugagagcgagcggccgggucaccguguccacgaaacgcucucagcagacagugauuccgaauaucggguucagacccuggguccggggacugagcucccgcauuagcaucuauuggaccauuguuaagccuggcgacauccuccugaucaacucuacagggaaccuuauugcccccagaggauacuuuaagauccggaauggcaaauccagcauuaugcgcucugaugcuccuaucggcaacuguagcuccgagugcauuacccccaaugggucuaucccgaacgacaagccuuuccagaaugugaacagaaucaccuauggagccuguccccgguacgugaaacaaaauacacugaagcucgcuacgggcaugcgcaacgucccugaaaaacagaccagagggauuuuuggagccaucgcgggcuucauugagaaugggugggaaggaaugguggauggcugguauggcuuucggcaccagaacagcgaggggacaggacaggccgcugaccugaaguccacccaagccgcuaucgaucagauuaauggcaaacuuaacagacugaucgagaagacaaaugaaaaguuccaucagaucgagaaagaauuuagcgagguugaagggcgcauucaagaccucgagaaguacguggaggauaccaaaaucgaccuguggucuuauaacgccggacugcucgucgcccuggaaaaucagcacacgauugaucuuacagacuccgagaugaacaagcuguuugaacggaccagaaaacagcuccgcgagaacgcugaagauaugggcaaugggugcuucaagaucuaccauaagugugacaacgcgugcauuggcagcauccggaauggaaccuacgaccacgauguguauagagacgaggcccugaacaaucgcuuucagauuaaaggcguugagcuuaagucuggguacaaagauuggauccuguggaucuccuucgcuauuagcugcuuucuccugugugugguccugcucggauucaucaugugggccugccaaaagggcaacauucgguguaauaucugcauuuga

SEQ ID NO: 184383 - RNA, 1698 nt, Artificial Sequence
  derived and/or modified sequence opt5 from hemagglutinin__InfluenzaA__ABJ09151
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaagggcaaagaggugcugguccucuggggagugcaucacccuccgaacaucggggaucagagagcccuguaccacacagaaaacgcuuaugugagcgucguuuccucucauuacagccggcgcuucacccccgagauugccaagagaccuaaagugcgggaccaggaaggccgcaucaauuauuacuggacgcuucuggagcccggggauacaauuaucuuugaagcgaacggaaaucucauugccccuugguaugcuuucgcccuguccagaggcuuuggcagcgggaucauuaccucuaacgcucccaugggagagugugacgccaagugccagacaccgcaaggcgcgaucaauuccagccuuccuuuccagaacgugcaccccgucaccaucggggaguguccuaaguacgugcggucugccaaacugcgcaugguuaccggacucagaaauauucccagcauccagucccggggccuguuuggggcuauugccggauucaucgaaggcggcuggacagggaugguggauggaugguauggcuaccaucaccagaacgagcaagggucuggauacgcugccgaccaaaagagcacgcagaaugccauuaacggcaucaccaauaaagucaacuccgugaucgaaaagaugaauacacaguuuaccgcuguugggaaagaguucaacaagcuggaacgcagaauggagaaucucaacaaaaagguggaugacggcuuccuggauauuuggacauauaacgcggagcuucugguccuccuggaaaaugagcggacccuugacuuucacgacagcaacgugaagaaucuguacgaaaaagucaagucucagcucaaaaacaaugccaaggagaucggaaacggcugcuucgaauuuuaucauaaauguaauaacgagugcauggaguccgugaagaaugggacguacgauuaucccaaguacagcaaagaaucuaagcugaaccgcgagaaaauugacggaguuaagcuggaauccaugggcguguaucagauccucgcuauuuacagcacagucgccuccucucuggugcuucugguuagccucggggccaucuccuucuggaugugcucuaauggaagccugcaguguagaaucugcauuuga

SEQ ID NO: 184384 - RNA, 1701 nt, Artificial Sequence
  derived and/or modified sequence opt5 from hemagglutinin__InfluenzaA__ABJ09162
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacgaauaacgaucagauuucucucuaugcgcaggccuccggccgcaucacaguuagcaccaagagaucccaacagacagugauuccgaauaucgggucucggccccgcgucagagacauuccuagccggaucuccaucuacuggaccauugugaaacccggagauauccugcugauuaacagcaccggcaaucucaucgcuccucgcggguacuuuaagauuagaucuggaaaguccagcaucaugcggucugacgcccccaucggcaaauguaacagcgagugcauuacaccgaauggcuccaucccuaacgacaagcccuuccagaaugugaaccgcauuacguauggggcuuguccuagauacgucaaacagaauacccugaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacucaaccggcugauuggcaagaccaaugagaaguuccaccagaucgaaaaagaguucuccgaaguggaggggcgcauucaggaucuugaaaaguacgucgaggacacgaaaaucgaucuguggagcuauaacgccgagauucucguggcucuggaaaaucaacauacaaucgaccugaccgauucugagaugaacaagcucuuugaaagaaccaaaaagcagcugcgggagaaugcggaagacaugggaaacggcugcuucaagaucuaccacaaaugugauaaugccugcauuggguccaucagaaacggcacauaugaccaugauguuuaccgcgacgaggcucuuaauaaccgguuucagauuaagggaguggagcugaaaagcggcuacaaggacuggauccucuggauuucuuucgccaucuccugcuuucugcuuugugucgcccugcucggguucaucaugugggcuugccagaaaggaaauauuagauguaacaucugcauuuga

SEQ ID NO: 184385 - RNA, 1701 nt, Artificial Sequence; identical to SEQ ID NO: 183267
  derived and/or modified sequence opt5 from hemagglutinin__InfluenzaA__ABJ09173

SEQ ID NO: 184386 - RNA, 1698 nt, Artificial Sequence
  derived and/or modified sequence opt5 from hemagglutinin__InfluenzaA__ABJ09184
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggaggcgggagauacaauuaucuuugaggccaacggcaaucucauugcucccagauucgccuuugcucugucccggggguucggaagcggcaucauuaccucuaacgccccuauggacgaaugugaugcgaagugccagacaccccaaggcgccaucaauuccagccuuccguuucagaacgugcacccugucaccaucggggagugucccaaauaugugcgcucugcuaagcugagaauggccaccggacuccggaauauuccuagcauccagucccgcggccuguucggggcuauugccggauuuaucgaaggcggguggacaggaaugguugacggcugguacggcuaucaucaccagaacgagcaagggucuggauacgccgcugaucagaaaagcacgcagaaugcgauuaacggcaucaccaauaaggugaacuccgucaucgaaaagaugaauacacaguucaccgccguggggaaagaguucagcaaacuggagagacggauggaaaaccucaauaagaagguugacgauggauuucuggacauuuggacauacaacgcugagcuucuggugcuccuggaaaacgagcgcacccuugacuuccacgauucuaaugucaaaaaccuguaugaaaaggugaaaucccaacucaagaauaacgccaaagagaucggcaaugggugcuuugaguucuaccauaaguguaacgacgaaugcauggagagcgucaagaauggcacguaugauuaccccaaauauucugaagaguccaagcugaacagagagaaaauugacggagugaagcuggaaagcaugggcguuuaccagauccucgccauuuauuccacaguggcuucuagccugguccuucuggugucccucggggccaucucuuuuuggaugugcagcaauggaucccugcagugucggaucugcauuuga

SEQ ID NO: 184387 - RNA, 1701 nt, Artificial Sequence; identical to SEQ ID NO: 183657
  derived and/or modified sequence opt5 from hemagglutinin__InfluenzaA__ABJ09195

SEQ ID NO: 184388 - RNA, 1701 nt, Artificial Sequence; identical to SEQ ID NO: 183657
  derived and/or modified sequence opt5 from hemagglutinin__InfluenzaA__ABJ09206

SEQ ID NO: 184389 - RNA, 1701 nt, Artificial Sequence; identical to SEQ ID NO: 184237
  derived and/or modified sequence opt5 from hemagglutinin__InfluenzaA__ABJ09217

SEQ ID NO: 184390 - RNA, 1701 nt, Artificial Sequence; identical to SEQ ID NO: 183674
  derived and/or modified sequence opt5 from hemagglutinin__InfluenzaA__ABJ09228

SEQ ID NO: 184391 - RNA, 1701 nt, Artificial Sequence
  derived and/or modified sequence opt5 from hemagglutinin__InfluenzaA__ABJ09239
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgauggaauuuaacaaugagucuuucaacuggaccggcguggcucaaaauggcacauccagcgccugcaaacgcagaucuaacaaguccuuuuucagccggcugaauuggcuccaccagcugaaguauaaauacccugcgcuuaacgucaccaugcccaauaacgagaaguuugacaaacuguauauuuggggagugcaucacccuucuacagauuccgaccagaucagccucuacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcugaucaauuguacaggcaaccucauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacugaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccuuaagagcacccaggccgccaucaaccagauuaauggaaaacucaacagacugaucgaaaagacaaaugagaaguuucaucagaucgaaaaagaguucucugaaguggagggccggauucaggaucuugagaaguauguugaagacaccaaaaucgaucugugguccuacaacgcugagcuccugguggcgcuggaaaaccaacacacgauugaccucacagauagcgagaugaauaagcuguucgaaagaaccaaaaagcagcuucgcgagaacgccgaggacauggggaauggauguuuuaagaucuaucauaaaugcgauaacgcuugcauuggcucuauccggaaugggaccuacgaccacgaugucuacagagacgaagcccugaacaaucgcuuccagauuaagggcguggagcucaaauccggauauaaggacuggauccuguggaucagcuuugccauuuccuguuuccuucugugcguugugcuccugggcuuuaucaugugggcuugucagaaagggaacauucggugcaauaucuguauuuga

SEQ ID NO: 184392 - RNA, 1701 nt, Artificial Sequence
  derived and/or modified sequence opt5 from hemagglutinin__InfluenzaA__ABJ09250
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcauccaucacccuucuacagauuccgaccagauuagccuguacgcccaggcuuccgggagagugaccguuucuacgaagcggagccaacagacagugaucccgaacauuggaucccgccccugggucagaggcgugagcucucggaucuccauuuacuggaccaucgugaaaccuggggauauccugcucauuaauagcacaggaaaccugaucgcuccccgcggcuauuucaagauuagaucuggaaagagcuccaucaugcggucugacgccccuauugggaaauguaauagcgaaugcaucacccccaacggcuccaucccgaaugacaagccuuuucagaacgucaaucgcauuaccuacggcgccugucccagauauguuaaacagaacacacuuaagcuggcgacggggaugcggaaugugccugagaaacaaacccgcggaaucuucggcgccauugcuggguuuaucgaaaacggaugggagggcaugguggaugggugguacggauucagacaccagaauagcgagggcacaggccaggccgcugaccucaagucuacccaagccgccauuaaccagaucaaugggaaacugaaccggcuuaucgaaaagacaaaugagaaguuucaucagauugaaaaagaguucuccgaagucgagggaagaauccaggaucuggagaaguauguggaagacaccaaaauugaucucuggagcuacaacgcugagcugcugguugcgcucgaaaaccaacacacgaucgaccugacagauucugagaugaauaaacuuuucgaacgcaccaagaagcagcugcgggagaacgccgaggacaugggcaaugggugcuuuaagauuuaucauaaaugugauaacgcuugcaucggauccauuagaaaugaaaccuacgaccacgauguguaccgcgacgaggcccucaacaaucgguuccagaucaagggcgucgaacugaaaagcggguauaaggacuggauccuuuggauuuccuuugccaucucuugcuuccugcucugugugguucugcugggcuuuauuaugugggcuugccagaaaggaaacaucagauguaauauuugcaucuga

SEQ ID NO: 184393 - RNA, 1701 nt, Artificial Sequence
  derived and/or modified sequence opt5 from hemagglutinin__InfluenzaA__ABJ09261
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcaccagauccuggauggggagaauuguacccucaucgacgcccugcugggagauccccauugcgacggcuuucagaacaaggaaugggaucucuucgucgagagaagcaaagccuauuccaauuguuacccuuaugacgugcccgauuacgcuucucugcggagccuuguugccuccagcgggacgcuggaauuuaacaaugagucuuucaacuggaccggaguggcucaaaauggcacauccagcgccugcaagcgcagaucuauuaaguccuuuuucagccggcucaacuggcugcaccagcuuaaauauaaguacccugcgcugaaugucaccaugcccaacaaugagaaauuugacaagcucuauaucuggggcgugcaucacccuucuacagauuccgaccagaccagccuguacgcccaggcuuccgggcgcguuacggugucuacaaaaagaagccaacagaccgucauuccgaacaucggaucccggcccugggugcgcggcgugagcucuagaauuuccaucuacuggacaauugucaagccuggggauauccugcucaucaacagcaccggaaaucugauugcuccccggggcuauuucaagauccgcucugggaaaagcuccauuaugagaucugacgccccuaucggaaaguguaacagcgaaugcauuacccccaauggcuccaucccgaacgacaaaccuuuucagaauguuaaccggaucacauacggcgccuguccccgcuaugugaagcagaauacgcuuaaacuggcgaccgggaugagaaacgugccugagaagcaaacacggggaauuuucggcgccaucgcuggguuuauugaaaauggaugggagggcauggucgaugggugguacggauuccgccaccagaacagcgagggcaccggccaggccgcugaccucaaaucuacacaagccgccaucaaucagauuaacgggaagcugaauagacuuaucgaaaagaccaacgagaaauaucaucagaucgaaaaggaguuuuccgaaguggagggacggauucaggaucuggagaaauacguugaagacacgaagaucgaucucuggagcuauaaugcugagcugcugguggcgcucgaaaaccaacacacaauugaccugaccgauucugagaugaacaaacuuuucgaaagaacccgcaagcagcugcgggagaaugccgaggacaugggcaacgggugcuucaagaucuaccauaaaugugauaaugcuugcauuggauccaucagaaacggcacauacgaccacgaugucuaucgcgacgaagcccucaauaaccgguuucagauuaaggggguggagcugaaaagcggcuacaaggacuggauccuuuggaucuccuucgccauuucuugcuuucugcucuguguugugcugcugggauucaucaugugggcuugccagaaaggcaauauuagauguaacaucugcauuuga

SEQ ID NO: 184394 - RNA, 1701 nt, Artificial Sequence
  derived and/or modified sequence opt5 from hemagglutinin__InfluenzaA__ABJ09272
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggcgcaaggccuauagcaacuguuacccuuaugaugugcccgacuacgcuucccugagaucucuuguugccagcuccgggacgcuggaauuuaauaacgagagcuucaauuggaccggaguggcucaaaacggcacaucuuccgccugcaaacggcgcagcauuaaguccuuuuucucuagacucaauuggcugcaccagcuuaaguauaaauacccugcgcugaacgucaccaugcccaauaacgagaaguuugauaaacucuauaucuggggcgugcaucacccuagcacagacucugaucagauuucccuguacgcccaggcuagcgggcggguuaccguguccacgaagcgcucucaacagacagucaucccgaacauuggaagcagacccugggugcggggcguguccagccgcaucucuauuuacuggaccaucgucaaaccuggggacauccugcucauuaauuccacaggaaaccugaucgcccccagaggcuauuucaagauucggagcgggaagucuagcaucaugcgcuccgaugcuccuauuggaaaauguaauucugaaugcaucacccccaacggcagcaucccgaaugacaagccuuuucagaacguuaauagaauuaccuacggcgccuguccccgguaugugaaacagaacacacuuaagcuggcgacggggaugcgcaaugugccugagaaacaaaccagaggaaucuucggcgccauugcuggguuuaucgaaaacggaugggagggcauggucgacgggugguacggauuccggcaccaaaauuccgagggcacaggccaggccgcugaucucaagagcacccaggccgccauuaaccagaucaaugggaaacugaacagacuuaucgaaaagacaaaugagaaguuucaucagauugaaaaagaguucucugaaguggagggacgcauccaggaccuggagaaggauguugaagacaccaaaauugaucucugguccuauaacgcugagcugcugguggcgcucgaaaaccaacacacgaucgaccugacagauagcgagaugaauaaacuuuucgaacggaccaagaagcagcugagagagaacgccgaggacaugggcaaugggugcuuuaagauuuaccauaaaugugauaacgcuugcaucggaucuauucgcaauggcaccuaugaccacgaugucuaccgggacgaagcccucaacaauagauuccagaucaaggggguggagcugaaauccggcuacaaggacuggauccuuuggauuagcuuugccaucuccugcuuccugcucuguguugugcugcugggauuuauuaugugggcuugccagaaaggcaacauccgcuguaauauuugcaucuga

SEQ ID NO: 184395 - RNA, 1701 nt, Artificial Sequence; identical to SEQ ID NO: 183096
  derived and/or modified sequence opt5 from hemagglutinin__InfluenzaA__ABJ09294

SEQ ID NO: 184396 - RNA, 1701 nt, Artificial Sequence
  derived and/or modified sequence opt5 from hemagglutinin__InfluenzaA__ABJ09305
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccccugggugagaggcgugagcucucggauuuccaucuacuggaccauugucaaaccuggggauauccugcucaucaauagcacaggaaaccugauugcccccagaggcuauuucaagaucagaucuggaaagagcuccauuaugcggucugacgcuccuaucgggaaauguaauagcgaaugcauuacccccaacggcuccaucccgaaugacaagccuuuucagaacguuaaucgcaucaccuacggcgccugucccagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaccagaauagcgagggcacaggccaggccgcugaccucaagucuacccaagccgccaucaaccagauuaaugggaaacugaaccggcuuaucgaaaagacaaaugagaaguuucaucagaucgaaaaagaguucuccgaaguggagggacgcauucaggaucuggagaaguauguugaagacaccaaaaucgaucucuggagcuacaacgcugagcugcugguggcgcucgaaaaccaacacacgauugaccugacagauucugagaugaauaaacuuuucgaacgcaccaagaagcagcugcgggagaacgccgaggacaugggcaaugggugcuuuaagaucuaucauaaaugugauaacgcuugcauuggauccaucagaaaugaaaccuacgaccacgaugucuaccgcgacgaggcccucaacaaucgguuccagauuaagggcguggaacugaaaagcggguauaaggacuggauccuuuggaucuccuuugccauuucuugcuuccugcucuguguugugcugcugggcuuuaucaugugggcuugccagaaaggaaacauuagauguaauaucugcauuuga

SEQ ID NO: 184397 - RNA, 1701 nt, Artificial Sequence
  derived and/or modified sequence opt5 from hemagglutinin__InfluenzaA__ABJ09316
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacgcuucucugcgcagccuuguugccuccagcgggacgcuggaauuuaacaaugagucuuucaacuggaccggaguggcucaaaauggcacauccagcgccugcaaaagacggucuaacaaguccuuuuucagccgccucaauuggcugcaccagcuuaaguauaaauacccugcgcugaacgucaccaugcccaauaacgagaaguuugacaaacucuauauuuggggcgugcaucacccuucuacagauuccgaccagaucagccuguacgcccaggcuuccgggagaguuaccgugucuacgaagcggagccaacagacagucauuccgaacaucggaucccgccacugggugagaggcgugagcucucggauuuccaucuacuggaccauugucaaacccggggauauccugcucaucaauagcacaggaaaccugauugccccucgcggcuauuucaagaucagaucugggaagucuuccauuaugcggucugacgcuagcaucggaaaauguaauuccgaaugcauuacccccaacggcagcaucccuaaugacaagcccuuucagaacguuaaucgcaucaccuacggcgccuguccgagauaugugaaacagaacacacuuaagcuggcgacggggaugcggaaugugccugagaaacaaacccgcggaauuuucggcgccaucgcuggguuuauugaaaacggaugggagggcauggucgaugggugguacggauucagacaucagaauagcgagggcacaggccaggccgcugaccucaaguccacccaagccgccaucaaccagauuaaugggaaacugaaccggcuuaucgaaaagacaaaugagaaguuucaccagaucgaaaaagaguucagcgaaguggagggacgcauucaggaucuggagaaguauguugaagacaccaaaaucgaucucuggucuuacaacgcugagcugcugguggcgcucgaaaaccaacauacgauugaccugacagauuccgagaugaauaaacuuuucgaaagaaccaagaagcagcugcgggagaacgccgaggacaugggcaaugggugcuuuaagaucuaucacaaaugugauaacgcuugcauuggaagcaucagaaauggcaccuacgaccacgaugucuaccgcgacgaagcccucaacaaucgguuccagauuaaggggguggagcugaaauccggcuauaaggacuggauccuuuggaucucuuuugccauuagcugcuuccugcucuguguugugcugcugggauuuaucaugugggcuugccagaaaggcaacauuagauguaauaucugcauuuga

SEQ ID NO: 184398 - RNA, 1701 nt, Artificial Sequence; identical to SEQ ID NO: 183674
  derived and/or modified sequence opt5 from hemagglutinin__InfluenzaA__ABJ09338

SEQ ID NO: 184399 - RNA, 1701 nt, Artificial Sequence
  derived and/or modified sequence opt5 from hemagglutinin__InfluenzaA__ABJ09349
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuuauucagucuagcuccacaggcgggaucugcgacucuccgcaccagauccuggauggagagaauuguacccucauugacgcccugcugggcgauccccauugcgacggguuucagaacaaagaaugggaucucuucguggagagaagcaaggccuauuccaauuguuacccuuaugacguccccgauuacgcuucucugcggagccuuguggccuccagcggaacgcuggaauuuaacaaugagucuuucaacuggaccggcguugcucaaaauggcacauccagcgccugcaaacgcagaucuaacaaguccuuuuucagccggcucaauuggcugcaccagcuuaaguauaaauacccugcgcugaacgugaccaugcccaauaacgagaaguuugacaaacucuauaucuggggaguccaucacccuucuacagauuccgaccagauuagccuguacgcccaggcuccggggcgcgugaccguuuccacgaagagaucucaacagacagugauccccaacauuggcagccggccuuggguccgcgggguguccagcagaaucucuauuuacuggaccaucgugaaacccggagauauccugcucauuaauuguacaggcaaccugaucgccccucggggguauuucaagauucgcuccggaaagagcucuaucaugagaagcgacgcuuccauuggcaaaugcaauucugaauguaucacccccaacggcagcaucccgaaugacaagccuuuucagaacgucaaucggauuaccuacggggccugcccccgcuauguuaaacagaacacacuuaagcuggcgacgggaaugagaaaugugccugagaaacaaacccggggcaucuucggggccauugcuggauuuaucgaaaacggcugggaggggaugguggauggaugguacggcuuccgccaccaaaauuccgagggcacagggcaggccgcugaccucaagagcacccaggccgccauuaaccagaucaauggaaaacugaacagacuuaucgaaaagacaaaugagaaguuucaucagauugaaaaagaguucucugaagucgagggccggauccaggaucuggagaaguauguggaagacaccaaaauugaucucugguccuacaacgcugagcugcugguugcgcucgaaaaccaacacacgaucgaccugacagauagcgagaugaauaaacuuuucgaaagaaccaagaagcagcugcgcgagaacgccgaggacauggggaauggauguuuuaagauuuaucauaaaugcgauaacgcuugcaucggcucuauucggaaugggaccuacgaccacgauguguacagagacgaagcccucaacaaucgcuuccagaucaagggcgucgagcugaaauccggauauaaggacuggauccuuuggauuagcuuugccaucuccuguuuccugcucugcgugguucugcugggcuuuauuaugugggcuugucagaaagggaacauccggugcaauauuuguaucuga

SEQ ID NO: 184400 - RNA, 1701 nt, Artificial Sequence; identical to SEQ ID NO: 183674
  derived and/or modified sequence opt5 from hemagglutinin__InfluenzaA__ABJ09360

SEQ ID NO: 184401 - RNA, 1701 nt, Artificial Sequence
  derived and/or modified sequence opt5 from hemagglutinin__InfluenzaA__ABJ09371
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggcugcgcgugagagacauccccucccggaucagcauuuacuggaccaucgucaagccuggagauauucugcucaucaacucuaccggcaaucugauugcuccccgcggguauuuuaaaaucagauccggaaagagcucuaucaugcggagcgacgccccuauuggcaaguguaacuccgaaugcaucacacccaauggcucuauuccgaacgacaaaccuuuccagaaugugaaccgcaucacguacggggcuugucccagauaugugaagcagaauacccuuaaacuggccacaggaaugcggaacgucccugagaagcaaacccgcggcauuuuuggggcgaucgccggauucaucgaaaauggcugggaggggaugguugauggaugguacggcuuuagacaccagaacagcgagggcauugggcaggcugccgaccucaaauccacacaagcugccaucgaucagauuaauggaaagcugaaccggcuuaucggcaaaaccaaugaaaaguuccaccagauugagaaggaguucagcgaaguggaagggagaauccaggaccuggagaaauauguggaggauacgaagauugaccucuggucuuacaacgccgaacugcuggucgcucucgagaaccaacauacaaucgaucugaccgacuccgaaaugaauaaacuuuuugagcgcaccaagaaacagcugcgggaaaacgcggaggauaugggaaauggcugcuucaagaucuaucacaagugugacaacgccugcauugggagcaucagaaauggcacauacgaucaugacguguaccgcgacgaggcucucaacaaucgguuucagauuaaaggaguugaacugaagucuggcuauaaagauuggauccuuuggauuuccuucgccaucagcugcuuucugcucuguguggcccugcugggguucaucaugugggcuugccagaagggaaacauuagauguaauaucugcauuuga

SEQ ID NO: 184402 - RNA, 1701 nt, Artificial Sequence; identical to SEQ ID NO: 183657
  derived and/or modified sequence opt5 from hemagglutinin__InfluenzaA__ABJ09382

SEQ ID NO: 184403 - RNA, 1701 nt, Artificial Sequence
  derived and/or modified sequence opt5 from hemagglutinin__InfluenzaA__ABJ16587
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccagauccuugauggggagaauuguacccugaucgacgcccuccugggagauccccauugcgacggcuuucagaacaaagaaugggaucuguucgucgagcgguccaaggccuauucuaauuguuacccuuaugacgugcccgauuacgcuagccuccgcucccugguugccagcucugggacgcuugaauuuaacaaugaguccuucaacuggaccggaguggcucaaaauggcacaagcucugccugcaaaagacgguccauuaagagcuuuuucucucgccugaacuggcuccaccagcugaaguauagauacccugcgcuuaaugucaccaugcccaacaaugacaaauuugauaagcuguauaucuggggcgugcaucacccuuccacagacagcgaucagaccucccucuacgcccaggcuucugggcggguuacggugagcacaaaacgcucccaacagaccgucauuccgaacaucggaagcagacccugggugcggggcgugucuucccgcauuagcaucuacuggacaauugucaagccuggggacauccugcugaucaacucuaccggaaaucucauugcccccagaggcuauuucaaaauccggagcgggaaguccucuauuaugcgcagcgacgcuccuaucggaaaguguaacuccgagugcauuacccccaauggcagcaucccgaacgauaaaccuuuucagaauguuaacagaaucacauacggcgccuguccccgguaugugaagcagaauacgcugaaacuugcgaccgggaugcgcaacgugccugaaaagcaaacaagaggaauuuucggcgccaucgcuggguuuauugagaauggaugggaaggcaugauggacgggugguacggauuccggcaccagaacucugagggcaccggccaggccgcugaucugaaauccacacaagccgccaucaaucagauuaacgggaagcucaauagacugaucgagaaaaccaacgaaaaguuucaucagaucgagaaggaguucagcgaagucgaaggacgcauucaggaccuugagaaauauguggaggauacgaagaucgaccuguggucuuacaaugcugaacuccugguugcgcuggagaaccaacacacaauugaucucaccgacuccgaaaugaacaaacuguucgagcggaccagaaagcagcuucgcgaaaaugccgaggauaugggcaacgggugcuuuaaaaucuaucauaagugugacaaugcuugcauuggaagcauccggaacggcacauacgaucacgacguguacagagacgaggcccugaauaaccgcuuccagauuaagggggucgaacucaaauccggcuauaaggauuggauccuguggaucucuuuugccauuagcugcuuccuucugugugugguucuccugggauuuaucaugugggcuugccagaaaggcaauauucgguguaacaucugcauuuga

SEQ ID NO: 184404 - RNA, 1701 nt, Artificial Sequence
  derived and/or modified sequence opt5 from hemagglutinin__InfluenzaA__ABJ16598
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggagcaaggccuauuccaacuguuacccuuaugaugugcccgacuacgcuucucugcgcagccuuguugccuccagcgggacgcuggaauuuaauaacgagucuuucaauuggaccggaguggcucaaaacggcacauccagcgccugcaaaagacggucuauuaaguccuuuuucagccgccucaauuggcugcaccagcuuaaguauaaauacccugcgcugaacgucaccaugcccaauaacgagaaguuugauaaacucuauaucuggggcgugcaucacccuucuacagacuccgaucagauuagccuguacgcccaggcuuccgggagaguuaccgugucuacgaagcggagccaacagacagucaucccgaacauuggaucccgccccugggugagaggcgugagcucucggaucuccauuuacuggaccaucgucaaaccuggggacauccugcucauuaauagcacaggaaaccugaucgcuccccgcggcuauuucaagauuagaucuggaaagagcuccaucaugcggucugaugccccuauugggaaauguaauagcgaaugcaucacccccaacggcuccaucccgaaugacaagccuuuucagaacguuaaucgcauuaccuacggcgccugucccagauaugugaaacagaacacacuuaagcuggcgacggggaugcggaaugugccugagaaacaaacccgcggaaucuucggcgccauugcuggguuuaucgaaaacggaugggagggcauggucgacgggugguacggauucagacaccagaauagcgagggcacaggccaggccgcugaucucaagucuacccaagccgccauuaaccagaucaaugggaaacugaaccggcuuaucgaaaagacaaaugagaaguuucaucagauugaaaaagaguucuccgaaguggagggaagaauccaggaccuggagaaguauguugaagauaccaaaauugaccucuggagcuacaacgcugagcugcugguggcgcucgaaaaccaacacacgaucgaucugacagacucugagaugaauaaacuuuucgaacgcaccaagaagcagcugcgggagaacgccgaggauaugggcaaugggugcuuuaagauuuaucauaaaugugacaacgcuugcaucggauccauuagaaauggcaccuacgaucacgacgucuaccgcgaugaagcccucaacaaucgguuccagaucaaggggguggagcugaaaagcggcuauaaggacuggauccuuuggauuuccuuugccaucucuugcuuccugcucuguguugugcugcugggauuuauuaugugggcuugccagaaaggcaacaucagauguaauauuugcaucuga

SEQ ID NO: 184405 - RNA, 1701 nt, Artificial Sequence
  derived and/or modified sequence opt5 from hemagglutinin__InfluenzaA__ABJ16620
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggaacaaggccuauagcaauuguuacccuuaugaugugcccgacuacgcuucccugcgcucucuuguugccagcuccgggacgcuggaauuuaacaaugagagcuucaacuggaccggaguggcucaaaauggcacaucuuccgccugcaaaagacggagcauuaagucuuucuucucccgccucaacuggcugcaccagcuuaaguauaaauacccugcgcugaaugucaccaugcccaacaacgagaaguuugauaaacucuauaucuggggcgugcaucacccuagcacagacucugaucagauuucccuguacgcccaggcuagcgggagaguuaccguguccacgaagcggucucaacagacagucaucccgaauauuggaagccgccccugggugagaggcguguccagccggaucucuauuuacuggaccaucgucaaaccuggggacauccugcucauuaacuccacaggaaaucugaucgcuccccgcggcuauuucaagauuagaagcgggaagucuagcaucaugcgguccgaugccccuauuggaaaauguaacucugaaugcaucacccccaauggcagcaucccgaacgacaagccuuuucagaauguuaaccgcauuaccuacggcgccugucccagauaugugaaacagaauacacuuaagcuggcgacggggaugcggaacgugccugagaaacaaacccgcggaaucuucggcgccauugcuggguuuaucgaaaauggaugggagggcauggucgacgggugguacggauucagacaccagaacuccgagggcacaggccaggccgcugaucucaagagcacccaagccgccauuaaucagaucaacgggaaacugaaucggcuuaucgaaaagacaaacaagaaauuucaucagauugagaaggaauuuucugagguggaaggaagaauccaggaccuggagaaauauguugaggauaccaagauugaccucugguccuacaacgcugaacugcugguggcgcucgagaaucaacacacgaucgaucugacagacagcgaaaugaacaaacuuuucgagcgcaccaagaagcagcugcgggaaaaugccgaggauaugggcaacgggugcuuuaaaauuuaucauaagugugacaaugcuugcaucggaucuauuagaaacggcaccuacgaucacgacgucuaccgcgaugaggcccucaauaaccgguuccagaucaaagggguggaacugaaguccggcuauaaagacuggauccuuuggauuagcuuugccaucuccugcuuccugcucuguguugugcugcugggauuuauuaugugggcuugccagaagggcaauaucagauguaacauuugcaucuga

SEQ ID NO: 184406 - RNA, 1701 nt, Artificial Sequence
  derived and/or modified sequence opt5 from hemagglutinin__InfluenzaA__ABJ16631
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagaagaccaaaaagcagcuucgcgaaaacgcggaggauaugggaaauggcugcuucaagaucuaucacaaaugugacaacgccugcauugggagcauccggaauggcacauacgaucaugacguguacagagacgaggcucugaacaaucgcuuucagauuaagggaguugaacucaaaucuggcuauaaggauuggauccuguggauuuccuucgccaucagcugcuuucuucuguguguggcccuccugggguucaucaugugggcuugccagaaaggaaacauucgguguaauaucugcauuuga

SEQ ID NO: 184407 - RNA, 1698 nt, Artificial Sequence
  derived and/or modified sequence opt5 from hemagglutinin__InfluenzaA__ABJ16664
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggcauuuugccgacuacgaggaacugagagagcaacucuccucugucagcuccuucgaacgguuugagaucuuccccaaggagagcucuuggccuaaucacaccgugacaggaguuuccgccagcugcucucauaacggcaaguccagcuuuuaucgcaaucugcuuuggcugaccggcaaaaacgggcucuaccccaaucugucuaaguccuaugcuaacaauaaagaaaaggaggugcugguccucuggggagugcaccacccuccgaacaucggcgaucagagagcccuguaccauacagaaaacgcuuacgugagcgucguuuccucucacuauagccggcgcuucacccccgagauugccaaaagaccuaaggugcgggaccaggaagggcgcaucaauuacuauuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaucccgucaccaucggggaguguccuaaauacgugcgcucugccaagcugagaaugguuaccggacuccggaauauucccagcauccagucccgcggccuguucggggcuauugccggauuuaucgaaggcggguggacaggaaugguggacggcugguauggcuaccaccaccagaacgagcaagggucuggauaugcugccgaucagaaaagcacgcagaaugccauuaacggcaucaccaauaaggucaacuccgugaucgaaaagaugaauacacaguucaccgcuguugggaaagaguucaacaaacuggagagacggauggaaaaucucaacaagaagguggacgauggauuucuggacauuuggacauacaacgcggagcuucugguccuccuggaaaaugagcgcacccuugacuuccaugauagcaacgugaaaaaucuguacgaaaaggucaaaucucaacucaagaacaaugccaaagagaucggcaacgggugcuuugaguucuaucacaaguguaaugacgaaugcauggaguccgugaagaacggcacguacgauuaucccaaauacagcgaagagucuaagcugaauagagagcggauugacggaguuaaacuggaauccaugggcguguaucagauccucgcuauuuacagcacagucgccuccucucuggugcuucugguuagccucggggccaucuccuuuuggaugugcucuaacggaagccugcaguguagaaucugcauuuga

SEQ ID NO: 184408 - RNA, 1698 nt, Artificial Sequence; identical to SEQ ID NO: 184228
  derived and/or modified sequence opt5 from hemagglutinin__InfluenzaA__ABJ16675

SEQ ID NO: 184409 - RNA, 1698 nt, Artificial Sequence
  derived and/or modified sequence opt5 from hemagglutinin__InfluenzaA__ABJ16686
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacuccgucaucgaaaagaugaauacacaguucaccgcgguggggaaagaguucagcaaacuggagagacggauggaaaaccucaauaagaagguugacgauggauuucuggacauuuggacauacaacgccgagcuucuggugcuccuggaaaacgagcgcacccuugacuuccacgauucuaaugucaaaaaccuguaugaaaaggugaaaucccaacucaagaauaacgcuaaagagaucggcaaugggugcuuugaguucuaccauaaguguaacgacgaaugcauggagagcgucaagaauggcacguaugauuaccccaaauauucugaagaguccaagcugaacagagagaaaauugacggagugaagcuggaaagcaugggcguuuaccagauccucgccauuuauuccacaguggccucuagccugguccuucuggugucccucggggcuaucucuuuuuggaugugcagcaauggaucccugcagugucggaucugcauuuga

SEQ ID NO: 184410 - RNA, 1701 nt, Artificial Sequence
  derived and/or modified sequence opt5 from hemagglutinin__InfluenzaA__ABJ16697
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucgaaaagacaaaugagaaguuucaucagaucgaaaaagaguucucugaaguggagggccggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugcgcgagaacgccgaggacauggggaauggauguuuuaagaucuaucauaaaugcgauaacgcuugcauuggcucuauccggaaugggaccuacgaccacgaugucuacagagacgaagcccucaacaaucgcuuccagauuaagggcguggagcugaaauccggauauaaggacuggauccuuuggaucagcuuugccauuuccuguuuccugcucugcgcuguucugcugggcuuuaucaugugggccugucagaaagggaacauucggugcaauaucuguauuuga

SEQ ID NO: 184411 - RNA, 1701 nt, Artificial Sequence
  derived and/or modified sequence opt5 from hemagglutinin__InfluenzaA__ABJ16730
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaagagagcugguccuacaucgccgaaaccccgaaucccaagaacggcacguguuauccuggguacuucgccgacuaugaggagcugcgggaacaacuuucuagcguguccagcuuugagcgcuucgaaauuuuucccaaggauucuuccuggccuaaucauaccguuacaaaaggagugaccgcuagcugcucucacaacggcaaguccagcuucuacaaaaaucugcucuggcugacagagaagaacggccuuuaucccaaucugucuaaauccuacgucaacaagaaggggaaagaggugcucguucuguggggagugcaucacccuagcaauaugggcgaccagagagccaucuaccacaaggaaaacgcguaugucuccgugcugucuagccauuacucccggcgcuuuaccccggagaucgccagacggcccaaagugcgcgaucaggaagggagaauuaacuauuacuggacgcuccuggagccuggagacacaaucauuuucgaagcuaauggcaaccuuaucgcccccugguaugcuuuugcccugagccggggguucggaucuggcauuaucauuuccaaugcgagcaugggcgagugugaugccaagugccagaccccucaaggggcuaucaacucuagccuccccuuucagaauguccacccgguuacaaucggagaguguccuaaauacgugcgcuccaccaagcugagaauggugaccggccuucggaacguccccucuauucagagccgcgggcuguucggagccaucgcuggcuuuauugaagggggauggacaggcaugaucgacggcugguauggguaccaucaccagaaugagcaaggauccggcuacgccgccgaucagaaaagcacgcagaacgcuauuaaugggaucaccaacaagguuaauucuaucauugaaaagaugaacacacaguucaccgcggugggaaaagaguucaauaagcucgaaagacggauggagaaccugaauaaaaagguggacgauggcuuucuggacaucuggacauauaacgccgagcuccugguccuucuggaaaacgagcgcacccucgacuuccacgauuccaaugugaaaaaccuguacgaaaagguuaagaaucaacuuaaaaacaaugcuaaggagauugggaacggcugcuuugaguucuaucauaaauguaauaacgaaugcauggagagcgugaagaauggaacguacgacuauccuaaauacucuaaggaauccaagcugaacagagagaaaaucgauggcgucaagcucgaaagcauggggguguaucagauucuggccaucuacuccacagucgccucuagccuggugcuccugguuucccuuggagcuaucucuuuuuggaugugcagcaauggcucccugcagugucggauuugcaucuga

SEQ ID NO: 184412 - RNA, 1701 nt, Artificial Sequence
  derived and/or modified sequence opt5 from hemagglutinin__InfluenzaA__ABJ16741
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaagggguuuuucucccggcucaauuggcugcaccagcuuaaguauaaauacccugcgcugaacgucaccaugcccaauaacgagaaguuugacaaacucuauauuuggggagugcaucacccuagcacagauucugaccagaucucccuguacgcccaggcuccgggccgcguuaccgugagcacgaagagaucccaacagacagucauucccaacaucgggucucggccuugggugcgcggagugagcuccauuaucagcauuuacuggaccaucgucaaacccggcgauauccugcucauuaauuguacagggaaccugaucgccccuagaggauauuucaagauucggucuggcaaguccagcaucaugcgcucugacgcuagcauuggcaaaugcaauuccgaauguaucacccccaacgggucuaucccgaaugacaagccuuuucagaacguuaauagaauuaccuacggagccugcccccgguaugugaaacagaacacacuuaagcuggcgacgggcaugcgcaaugugccugagaaacaaaccagagggaucuucggagccauugcuggcuuuaucgaaaacgggugggagggaauggucgauggcugguacggcuuccggcaccagaauagcgaggggacaggacaggccgcugaccucaaguccacccaagccgccauuaaccagaucaauggcaaacugaaccgccuuaucgggaagacaaaugaaaaguuucaucagauugagaaagaguucagcgaaguggaaggaagaauccaggaucuggagaaguauguugaggacaccaaaauugaucucuggucuuacaacgcugaacugcugguggcgcucgagaaccaacacacgaucgaccugacagauuccgaaaugaauaaacuuuucgagcggaccaagaagcagcugagagaaaacgccgaggacaugggcaauggguguuuuaagauuuaucauaaaugcgauaacgcuugcaucggcagcauucgcaauggaaccuacgaccacgaugucuaccgggacgaggcccucaacaauagauuccagaucaagggcguggaacugaaaucuggguauaaggacuggauccuuuggauuuccuuugccaucagcuguuuccugcucugcguugugcugcugggauuuauuaugugggcuugucagaaaggcaacauccgcugcaauauuuguaucuga

SEQ ID NO: 184413 - RNA, 1701 nt, Artificial Sequence
  derived and/or modified sequence opt5 from hemagglutinin__InfluenzaA__ABJ16752
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcggaauuucuaucuacuggaccauugucaaacccggcgauauccugcucaucaauuguacagggaaccugauugccccuagaggauauuucaagauccgguccggcaagagcucuauuaugcgcagcgacgcuuccaucggcaaaugcaauucugaauguauuacccccaacgggagcaucccgaaugacaagccuuuucagaacguuaauagaaucaccuacggagccugcccccgguaugugaaacagaacacacuuaagcuggcgacgggcaugcgcaaugugccugagaaacaaaccagagggauuuucggagccaucgcuggcuuuauugaaaacgggugggagggaauggucgauggcugguacggcuuccggcaccaaaauuccgaggggacaggacaggccgcugaccucaagagcacccaggccgccaucaaccagauuaauggcaaacugaaccgccuuaucgaaaagacaaaugagaaguuucaucagaucgaaaaagaguucucugaaguggaggggcggauucaggaucuggagaaguauguugaagacaccaaaaucgaucucugguccuacaacgcugagcugcugguggcgcucgaaaaccaacacacgauugaccugacagauagcgagaugaauaaacuuuucgaaagaaccaagaagcagcugagagagaacgccgaggacaugggaaauggcuguuuuaagaucuaucauaaaugcgauaacgcuugcauugggucuauccgcaauggcaccuacgaccacgaugucuaccgggacgaagcccucaacaauagauuccagauuaagggaguggagcugaaauccggcuauaaggacuggauccuuuggaucagcuuugccauuuccuguuuccugcucugcguugugcugcugggguuuaucaugugggcuugucagaaaggaaacauucgcugcaauaucuguauuuga

SEQ ID NO: 184414 - RNA, 1701 nt, Artificial Sequence
  derived and/or modified sequence opt5 from hemagglutinin__InfluenzaA__ABJ16763
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggcacugggugcgcgggguguccagcagaauuucuaucuacuggaccauugucaaaccuggagauauccugcucaucaauuguacaggcaaccugauugcuccccggggguauuucaagauccgcuccggaaagagcucuauuaugagaagcgacgccuccaucggcaaaugcaauucugaauguauuaccccuaacggcagcauccccaaugacaagccguuucagaacguuaaucggaucaccuacggggccugcccucgcuaugugaaacagaacacacuuaagcuggcgacgggaaugagaaaugugcccgagaaacaaacccggggcauuuucggggccaucgcuggauuuauugaaaacggcugggaggggauggucgauggaugguacggcuuccgccaucaaaauuccgagggcacagggcaggccgcugaccucaagagcacccaggccgccaucaaccagauuaauggaaaacugaacagacuuaucgaaaagacaaaugagaaguuucaccagaucgaaaaagaguucucugaaguggagggccggauucaggaucuggagaaguauguugaagacaccaaaaucgaucucugguccuacaacgcugagcugcugguggcgcucgaaaaccaacauacgauugaccugacagauagcgagaugaauaaacuuuucgaaagaaccaagaagcagcugcgcgagaacgccgaggacauggggaauggauguuuuaagaucuaucacaaaugcgauaacgcuugcauuggcucuauccggaaugggaccuacgaccacgaugucuacagagacgaagcccucaacaaucgcuuccagauuaagggcguggagcugaaauccggauauaaggacuggauccuuuggaucagcuuugccauuuccuguuuccugcucugcguugugcugcugggcuuuaucaugugggcuugucagaaagggaacauucggugcaauaucuguauuuga

SEQ ID NO: 184415 - RNA, 1701 nt, Artificial Sequence
  derived and/or modified sequence opt5 from hemagglutinin__InfluenzaA__ABJ16774
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcccgacaggaagaauuugcgacucuccccaucagauccuggauggcgagaauuguacccucaucgacgcccugcugggggauccucacugcgacggauuucagaacaaagaaugggaucucuucguggagcggucuacggccuauagcaauuguuaccccuaugacguuccugauuacgcuucccugcgcucucuuguggccagcuccggcacccuggaauuuaacaaugagagcuucaacuggacaggggucgcucagaauggaaccucuuccgccugcaagagacggagcauuaaauccuuuuucucccgccucaacuggcugcaucaacuuaaguauaaguaccccgcgcugaaugugacaaugccuaacaaugagaaauuugacaagcucuauaucuggggcguucaccacccgagcaccgauucugaccagauuucccuguacgcccaggcuagcggcagagugacggucuccacaaaacggucucagcaaaccgugauccccaacauugggagcggaccuugggugcgcggcgucuccagcagaaucucuauuuacuggacaaucguuaagcccggggauauccugcucauuaacuccaccggaaaucugaucgccccucggggcuauuucaaaauucgcaacgggaaaagcucuaucaugagaagcaauacccccauuggaaaguguaacuccgaaugcaucacaccgaauggcucuaucccuaacgacaaacccuuucagaaugugaaccggauuacguacggcgcuuguccucgcuaugugaagcagaauacccuuaaacuggccacagggaugagaaacguccccgagaagcagacccggggaaucuucggcgcgauugccggguuuaucgaaaauggaugggagggcaugguggacgggugguacggauuccgccaucaaaacagcgagggcacaggccaggcugccgaucucaaauccacccaggcugccauuaaucaaaucaacgggaagcugaauagacuuaucgaaaagacgaacgagaaguuucaccagauugaaaaggaguucagcgaaguugagggacggauccaggaccuggagaaauauguggaagauacaaagauugaccucuggucuuacaacgccgagcugcuggucgcucucgaaaaucagcauaccaucgaucugaccgacuccgagaugaacaaacuuuucgaaagaacacgcaagcaacugcgggagaaugcggaggauaugggcaacgggugcuuuaaaauuuaucacaagugugacaaugccugcaucggaagcauuagaaacggcaccuacgaucacgacguguaccgcgaugaagcucucaauaaccgguuccagaucaaggggguugagcugaaaucuggcuauaaggacuggauccuuuggauuuccuuugccaucagcugcuuccugcucugugugguccugcugggauuuauuaugugggccugccagaaaggcaauaucagauguaacauuugcaucuga

SEQ ID NO: 184416 - RNA, 1701 nt, Artificial Sequence
  derived and/or modified sequence opt5 from hemagglutinin__InfluenzaA__ABJ16785
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccuaugccugcaaacgcagaagcaacaaguccuuuuucucucggcucaauuggcugcaccagcuuaaguacaaauauccugcgcugaacgucaccaugcccaauaacgagaaguuugacaaacucuacauuuggggagugcaucacccuagcacagauucugaccagaucucccuguacgcccaggcuccggggcgcguuaccgugagcacgaagagaucccaacagacagucauucccaacaucggcucucggccuugggugcgcggggugagcuccagaauuagcaucuauuggaccauugucaaacccggagauauccugcucaucaauuguacaggcaaccugauugccccucggggguacuucaagauccgcucuggaaaguccagcauuaugagaucugacgcuagcaucggcaaaugcaauuccgaauguauuacccccaacggcucuaucccgaaugacaagccuuuucagaacguuaaucggaucaccuauggggccugcccccgcuacgugaaacagaacacacuuaagcuggcgacgggaaugagaaaugugccugagaaacaaacccggggcauuuucggggccaucgcuggauuuauugaaaacggcugggaggggauggucgauggaugguauggcuuccgccaccagaauagcgagggcacagggcaggccgcugaccucaaguccacccaagccgccaucaaccagauuaauggaaaacugaacagacuuaucgaaaagacaaaugagaaguuucaucagaucgaaaaagaguucagcgaaguggagggccggauucaggaucuggagaaguacguugaagacaccaaaaucgaucucuggucuuauaacgcugagcugcugguggcgcucgaaaaccaacacacgauugaccugacagauuccgagaugaauaaacuuuucgaaagaaccaagaagcagcugcgcgagaacgccgaggacauggggaauggauguuuuaagaucuaccauaaaugcgauaacgcuugcauuggcagcauccggaaugggaccuacgaccacgaugucuauagagacgaagcccucaacaaucgcuuccagauuaagggcguggagcugaaaucuggauacaaggacuggauccuuuggaucuccuuugccauuagcuguuuccugcucugcguugugcugcugggcuuuaucaugugggcuugucagaaagggaacauucggugcaauaucuguauuuga

SEQ ID NO: 184417 - RNA, 1701 nt, Artificial Sequence; identical to SEQ ID NO: 183934
  derived and/or modified sequence opt5 from hemagglutinin__InfluenzaA__ABJ53438

SEQ ID NO: 184418 - RNA, 1698 nt, Artificial Sequence; identical to SEQ ID NO: 183766
  derived and/or modified sequence opt5 from hemagglutinin__InfluenzaA__ABJ53449

SEQ ID NO: 184419 - RNA, 1701 nt, Artificial Sequence
  derived and/or modified sequence opt5 from hemagglutinin__InfluenzaA__ABJ53471
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgggaucugcgacucuccgcaccagauucuggauggagagaauuguacccuuaucgacgcccugcucggcgauccccagugcgacggguuucaaaacaaaaagugggaucuguucgucgaaagaagcaaagccuauuccaauuguuacccuuaugacgugcccgauuacgcuucucugcggagccucguugccuccagcggaacgcuggaguuuaacaaugaaucuuucaacuggaccggcgugacacagaauggcaccuccagcgcuugcaagcgcgggucuaacaauuccuuuuucagcagacuuaacuggcugacacaucucaaguuuaaauauccugcccugaaugucaccaugcccaacaacgagaaguucgacaaacuuuacauuuggggagugcaccauccuggcacggauaaugaccagaucuuucuguaugcgcaggccucugggcggauuacaguuuccaccaagcgcagccaacagacagugaucccgaacauuggauccagaccccggguccgcaauaucccuucuagaaucagcauuuacuggaccaucgugaaacccggcgauauucuccugaucaacuccaccgggaaucugauugcuccucggggauacuucaagauccgcagcggcaagucuuccaucaugagaagcgacgcccccauuggcaaauguaacucugagugcaucacaccgaaugggagcauuccuaacgacaagcccuuucagaaugugaaccggaucacguauggagcuuguccucgcuacgucaaacagaauacccucaagcuggccacaggcaugagaaacguucccgaaaaacaaacccgggggauuuucggagcgaucgccggcuuuaucgagaaugggugggaaggaaugguggauggcugguauggcuuccgccaccagaacuccgaggggauuggacaggcugccgaccuuaagucuacacaagcugccaucaaucagauuaacggcaaacugaacagacucaucgggaagaccaaugagaaguuccaccagauugaaaaagaguuuagcgaaguggagggacggauccaggaucuggaaaaguacgucgaggacacgaaaauugaucuuugguccuauaacgccgagcugcucguggcucuggaaaaucaacauacaaucgaccugaccgauagcgagaugaacaaacucuucgaaagaaccaagaagcagcugcgcgagaaugcggaagacaugggcaacgggugcuuuaagaucuaccacaaaugugauaaugccugcauuggcucuauccggaacggaacauaugaccaugauguuuacagagacgaggcucuuaauaaccgcuuccagauuaagggcguggagcugaaauccggguacaaggacuggauccucuggauuagcuuugccaucucuugcuuccugcuuugugucgcccugcucggauuuaucaugugggcuugccagaaaggcaauauucgguguaacaucugcauuuga

SEQ ID NO: 184420 - RNA, 1701 nt, Artificial Sequence
  derived and/or modified sequence opt5 from hemagglutinin__InfluenzaA__ABJ53482
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaagaaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggagugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggcgugcaccauccugggacggauaaugaccagauuuuucucuaugcgcaggccucuggaagaaucacaguuuccaccaaacggagccaacagacagugauuccgaacaucggcucccgccccagaguccggaauauuccuucucgcaucagcaucuacuggaccauugugaagcccggggauauccugcugauuaacuccaccggaaaucucaucgcuccuagaggcuacuucaaaauucggagcgggaagucuuccaucaugcgcagcgacgcccccaucggaaaguguaacucugaaugcauuacaccgaauggcagcaucccuaacgacaaacccuuucagaaugugaacagaauuacguauggcgcuuguccucgguacgucaagcagaauacccugaaacuugccacagggaugcgcaacguucccgagaagcaaaccagaggaaucuucggcgcgauugccggguuuaucgaaaauggaugggagggcaugguggaugggugguauggauuccggcaccagaacuccgagggcaucggccaggcugccgaccugaaaucuacacaagcugccauuaaucagaucaacgggaagcucaacagacugauuggaaaaaccaaugaaaaguuccaccagaucgagaaggaauuuagcgagguggaaggccgcauucaggaucuugagaaauacgucgaggacacgaagaucgaucugugguccuauaacgccgaacuccugguggcucuggagaaucaacauacaauugaccucaccgauagcgaaaugaacaaacuguucgagcggaccaagaaacagcuuagagaaaaugcggaggacauggggaacggaugcuuuaagaucuaccacaagugugauaaugccugcaucggcucuauucgcaacgggacauaugaccaugauguuuaccgggacgaggcucugaauaacagauuccagaucaaaggcguggaacucaaguccggauacaaagacuggauucuguggaucagcuuugccauuucuugcuuccuucugugugucgcccuccugggcuuuaucaugugggcuugccagaaggggaauauccgcuguaacauuugcaucuga

SEQ ID NO: 184421 - RNA, 1698 nt, Artificial Sequence; identical to SEQ ID NO: 184256
  derived and/or modified sequence opt5 from hemagglutinin__InfluenzaA__ABJ53493

SEQ ID NO: 184422 - RNA, 1698 nt, Artificial Sequence
  derived and/or modified sequence opt5 from hemagglutinin__InfluenzaA__ABJ53504
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugagcgcuucuugcucccacaacggcaagagcucuuuuuaccgcaaucuccuguggcuuaccgaaaagaacggccuguaucccaaucucuccaagagcuacguuaacaauaaagagaaggaagugcugguccuguggggagugcaucacccuuccaacaucggggugcagagagccauuuaccacacagagaacgcuuaugucucuguugugagcucccauuacagccggcgcuucaccccggaaaucgccaaaagacccaaggugcgggaucaggagggccgcauuaauuauuacuggacgcuccuggagccuggggacacaaucauuuuugaagcgaacggaaaucuuaucgcccccugguaugcuuucgcccugucuagaggcuuugaguccgggauuaucaccagcaacgcuccuaugaaugaaugugaugccaagugccagacaccccucggagcgaucaacucuagccugccguuccaaaauguccacccugugaccauuggcgagugucccaaauacguucgguccgccaaacuucgcauggugaccggccugagaaacaucccuucuauucagagccgggggcucuuuggagcuaucgccggcuucauugaagggggauggacaggcaugaucgacgggugguauggauaccaucaccagaaugagcagggcuccggcuacgcugccgaucagaaaagcacgcaaaacgccaucaaugggauuaccaacaaggucaauucugugaucgagaaaaugaacacacaguuuaccgcuguuggaaaggaguucaauaaacuggaacgcagaauggaaaaccugaacaagaagguggacgauggcuuccucgacauuuggacauauaaugcggagcugcuuguccugcucgaaaacgagcggacccuggauuuucacgacuccaaugugaaaaaccuuuacgagaaggucaaaagccagcugaagaauaacgccaaagaaaucgggaauggaugcuucgaguuuuaucauaaguguaacaaugaaugcauggagucugugaagaacggcacguacgacuaucccaaauacuccgaggaaagcaagcucaaucgcgagaaaauugaugggguuaagcuggaauccaugggcguguaucaaauccuggcuaucuacucuacagucgccagcucccucgugcugcuuguuucucugggagccauuagcuucuggaugugcuccaacggcagccuccaguguagaaucugcauuuga

SEQ ID NO: 184423 - RNA, 1701 nt, Artificial Sequence; identical to SEQ ID NO: 184411
  derived and/or modified sequence opt5 from hemagglutinin__InfluenzaA__ABJ53515

SEQ ID NO: 184424 - RNA, 1701 nt, Artificial Sequence
  derived and/or modified sequence opt5 from hemagglutinin__InfluenzaA__ABK39962
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacagaagacacuuaaacuggccacgggaaugcggaaugucccugagaagcaaacccgcggcauuuucggggcgaucgccggauuuauugaaaacggcugggaggggaugauggacggaugguacggcuucagacaccaaaauuccgagggcacagggcaggcugccgaucucaaaagcacccaggcugccaucaaccagauuaauggaaagcugaaccggcuuaucgaaaagacaaaugagaaauuucaucagaucgaaaaggaguucucugaaguggagggccgcauucaggaccuggagaaauauguugaagauaccaagaucgaccucugguccuacaacgccgagcugcugguggcucucgaaaaucaacacacgauugaucugacagacagcgagaugaacaaacuuuucgaaagaaccaagaagcagcugcgggagaacgcggaggauauggggaauggaugcuuuaaaaucuaucauaagugugacaacgccugcauuggcucuaucagaaaugggaccuacgaucacgacgucuaccgcgacgaagcucucaacaaucgguuccagauuaaaggcguggagcugaaguccggauauaaagauuggauccuuuggaucagcuuugccauuuccugcuuccugcucuguaucguucugcugggcuuuauuaugugggccugccagaaggggaacaucagauguaauauuugcaucuga

SEQ ID NO: 184425 - RNA, 1701 nt, Artificial Sequence; identical to SEQ ID NO: 183654
  derived and/or modified sequence opt5 from hemagglutinin__InfluenzaA__ABK39973

SEQ ID NO: 184426 - RNA, 1701 nt, Artificial Sequence
  derived and/or modified sequence opt5 from hemagglutinin__InfluenzaA__ABK39984
augaagaccaucauugcccugagcuacauccucugccugguguucgcucagaaacuucccggcaacgacaauuccagagccacacugugucucgggcaccaugcggucccuaacggaacgauuguuaagaccaucacaaaugaucaaauugaggugaccaacgcuacagaacuggugcagucuagcuccaccggcgggaucugcgacucuccgcaccagauccuugauggagagaauuguacacugauugacgcccuccugggcgauccccagugcgacggguuucaaaacaaaaagugggaucuguucgucgaacggagcaaagccuauuccaauuguuacccuuaugacgugcccgauuacgcuucucuccgcagccugguugccuccagcggaacccuugaguuuaacaaugaaucuuucaacuggacgggcgugacccagaauggcacauccagcgcuugcaagagacggucuaacaauuccuuuuucagccgccugaacuggcucacccaucugaaguuuaaauauccugcccuuaaugucacaaugcccaacaacgagaaguucgacaaacuguacaucuggggagugcaccauccugggaccgauaaugaccagauuuuucucuaugcgcaggccucuggcagaaucacgguuuccacaaagcggagccaacagaccgugauuccgaacaucgggucccgccccagaguccggaauauuccuucucgcaucagcaucuacuggacaauugugaaacccggagauauccugcugauuaacuccaccggcaaucucaucgcuccuagaggguacuucaagauucggagcggaaagucuuccaucaugcgcagcgacgcccccaucggcaaauguaacucugagugcauuaccccgaauggcagcaucccuaacgacaagcccuuucagaaugugaacagaauuacauauggggcuuguccucgguacgucaaacagaauacgcugaaacuugccaccggaaugcgcaacguucccgaaaagcaaacaagaggcaucuucggggcgauugccggauuuaucgagaauggcugggaagggaugguggauggaugguauggcuuccggcaccagaacuccgagggcaucgggcaggcugccgaccugaagucuacccaagcugccauugaucagaucaauggaaaacucaacagacugauuggcaagacaaacgagaaguuccaccagaucgaaaaagaguuuagcgaaguggaggggcgcauucaggaccuugaaaaguacgucgaggauaccaaaaucgaccugugguccuauaaugccgagcuccugguggcucuggaaaaccaacauacgauugaucucacagacagcgagaugaauaagcuguucgaacggaccaaaaagcagcuuagagagaacgcggaagauaugggaaauggcugcuuuaagaucuaccacaaaugugacaacgccugcaucgggucuauucgcaauggcaccuaugaucaugacguuuaccgggacgaggcucugaacaauagauuccagaucaagggaguggagcucaaauccggcuacaaggauuggauucuguggaucagcuuugccauuucuugcuuccuucugugugucgcccuccugggguuuaucaugugggcuugccagaaaggaaacauccgcuguaauauuugcaucuga

SEQ ID NO: 184427 - RNA, 1698 nt, Artificial Sequence
  derived and/or modified sequence opt5 from hemagglutinin__InfluenzaA__ABK39995
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucuguguacagcuucgaacgguuugagaucuuccccaaggaguccagcuggccuaaucauacggucaccggagugucugcuuccugcagccacaacggcaagucuuccuuuuaucgcaaucugcuuuggcugacaggcaaaaacgggcucuaccccaaucugagcaagucuuacgccaacaauaaagaaaaggagguucugauucucuggggagugcaucacccuccgaacaucggcaaccagagaacccuguaucacacagaaaaugcuuacgucuccguggugagcucccauuauucucggcgcuucacccccgagauuacgaaaagaccuaagguccgggaucaggaagggcgcaucaacuacuauuggacacuucuggagcccggagacaccauuaucuuugaggccaauggcaaccucauugcgccuugguacgccuucgcucugagcagaggguuuggauccggcaucaucacaagcaaugcccccauggaugaaugugacgcuaagugccagaccccgcaaggcgccauuaacucuucccuuccuuuccagaauguucaccccgugaccaucggggaguguccuaaauaugugcggagcgcgaagcugcgcauggucacaggacucagaaacauucccucuauccagagccggggccuguuuggggccauugcuggauucaucgaaggcggguggacgggaaugguggauggcugguacggcuaccaucaccagaaugagcaaggguccggauaugccgcugaccagaaaucuacccagaacgccaucaauggcauuacaaacaagguuaauagcgugaucgaaaagaugaacacccaguuuacagccgucgggaaagaguucaauaaacuggagcgcagaauggaaaaccucaacaagaagguggaugacggauuccuggauauuuggaccuacaaugcugagcuucugguucuccuggaaaacgagcggacgcuugacuuucacgacuccaaugugaaaaaccuguaugaaaaggucaaaagccaacucaagaauaacgcgaaagagaucggcaaugggugcuucgaguuuuaccauaaguguaacaaugaaugcauggagucugugaagaacggcacauaugauuaccccaaauauuccgaagagagcaagcugaaucgcgagaaaauugacggagucaagcuggauucuaugggcguguaccagauccucgccaucuacuccaccguugcuagcucccuggugcuucuggucucucucggggccauuagcuucuggaugugcuccaacggaucucugcaguguagaaucugcauuuga

SEQ ID NO: 184428 - RNA, 1701 nt, Artificial Sequence
  derived and/or modified sequence opt5 from hemagglutinin__InfluenzaA__ABK40017
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacaagaaauucgacaagcuguacaucuggggagugcaccauccugggacggauaaugaccagauuucucucuaugcgcaggccuccggccgcaucacaguuagcaccaaaagaucccaacagacagugauuccgaacaucgggucucggccccgcgucagagauauuccuagccggaucuccaucuacuggaccauugugaagcccggagacauccugcugauuaauagcaccggcaaccucaucgcuccucgcggguacuuuaagauuagaucuggaaaauccagcaucaugcggucugacgcccccaucggcaaguguaauagcgagugcauuacaccgaacggcuccaucccuaaugauaaacccuuccagaacgugaaucgcauuacguauggggcuuguccuagauacgucaagcagaacacccugaaacuugccacaggaaugcggaauguucccgagaagcaaacccgcggcaucuuuggggcgauugccggauucaucgaaaacggcugggaggggaugguggacggaugguauggcuuuagacaccaaaauucugaaggcaucgggcaggcugccgaucugaaaagcacacaggcugccauuaaccagaucaauggaaagcucaaccggcugauuggcaagaccaacgagaaauuccaccagaucgagaaggaguucuccgaaguggaagggcgcauucaggaccuugagaaauacgucgaagauacgaagaucgaccuguggagcuauaaugccgagcuccugguggcucuggagaaccaacauacaauugaucucaccgacucugaaaugaauaaacuguuugagagaaccaagaagcagcuucgggaaaacgcggaggauaugggaaauggcugcuucaaaaucuaccacaagugugacaacgccugcaucggguccauuagaaauggcacauaugaucaugacguuuaccgcgacgaagcucugaacaaucgguuucagaucaaaggaguggagcucaagagcggcuacaaagauuggauucuguggaucucuuucgccauuuccugcuuucuucugugugucgcccuccugggguucaucaugugggcuugccagaagggaaacaucagauguaauauuugcaucuga

SEQ ID NO: 184429 - RNA, 1701 nt, Artificial Sequence
  derived and/or modified sequence opt5 from hemagglutinin__InfluenzaA__ABK40028
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaagagagcugguccuacaucgccgaaaccccgaaucccaagaacggcacguguuauccuggguacuucgccgacuaugaggagcugcgggaacaacuuucuagcguguccagcuuugagcgcuucgaaauuuuucccaaggauucuuccuggccuaaucauaccguuacaaaaggagugaccgcuagcugcucucacaacggcaaguccagcuucuacaaaaaucugcucuggcugacagagaagaacggccuuuaucccaaucugucuaaauccuacgucaacaagaaggggaaagaggugcucguucuguggggagugcaucacccuagcaauaugggcgaccagagagccaucuaccacaaggaaaacgcguaugucaccgugcuguccucucauuacagccggcgcuuuacgccggagaucgccagacggcccaaagugcgcgaucaggaagggagaauuaacuauuacuggacacuccuggagccuggagacaccaucauuuucgaagcuaauggcaaccuuaucgcccccugguaugcuuuugcccugucccggggguucggaagcggcauuaucauuucuaaugcguccaugggcgagugugaugccaagugccagacaccucaaggggcuaucaacagcucucuccccuuucagaauguccacccgguuaccaucggagaguguccuaaauacgugcgcagcaccaagcugagaauggugacaggccuucggaacguccccuccauucagucucgcgggcuguucggagccaucgcuggcuuuauugaagggggauggacgggcaugaucgacggcugguauggguaccaucaccagaaugagcaaggaagcggcuacgccgccgaucagaaauccacccagaacgcuauuaaugggaucacaaacaaggugaauagcaucauugaaaagaugaacacccaguucacagcgguuggaaaagaguucaauaagcucgaaagacggauggagaaccugaauaaaaagguggacgauggcuuucuggacaucuggaccuauaacgccgagcuccugguccuucuggaaaacgagcgcacgcucgacuuccacgauucuaaugugaaaaaccuguacgaaaagguuaagaaucaacuuaaaaacaaugcuaaggagauugggaacggcugcuuugaguucuaucauaaauguaauaacgaaugcauggaguccgugaagaauggaacauacgacuauccuaaauacagcaaggaaucuaagcugaacagagagaaaaucgauggcgucaagcucgaauccauggggguguaucagauucuggccaucuacagcaccgucgccuccucucuggugcuccugguuagccuuggagcuaucuccuuuuggaugugcucuaauggcagccugcagugucggauuugcaucuga

SEQ ID NO: 184430 - RNA, 1701 nt, Artificial Sequence; identical to SEQ ID NO: 184411
  derived and/or modified sequence opt5 from hemagglutinin__InfluenzaA__ABK40039

SEQ ID NO: 184431 - RNA, 1701 nt, Artificial Sequence; identical to SEQ ID NO: 184411
  derived and/or modified sequence opt5 from hemagglutinin__InfluenzaA__ABK40050

SEQ ID NO: 184432 - RNA, 1701 nt, Artificial Sequence; identical to SEQ ID NO: 183674
  derived and/or modified sequence opt5 from hemagglutinin__InfluenzaA__ABK40061

SEQ ID NO: 184433 - RNA, 1701 nt, Artificial Sequence; identical to SEQ ID NO: 183674
  derived and/or modified sequence opt5 from hemagglutinin__InfluenzaA__ABK40075

SEQ ID NO: 184434 - RNA, 1701 nt, Artificial Sequence; identical to SEQ ID NO: 183945
  derived and/or modified sequence opt5 from hemagglutinin__InfluenzaA__ABK40510

SEQ ID NO: 184435 - RNA, 1701 nt, Artificial Sequence; identical to SEQ ID NO: 183945
  derived and/or modified sequence opt5 from hemagglutinin__InfluenzaA__ABK40534

SEQ ID NO: 184436 - RNA, 1701 nt, Artificial Sequence
  derived and/or modified sequence opt5 from hemagglutinin__InfluenzaA__ABK40546
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgcuccccugcagcugggcaaguguagcauugccggguggauccucggaaacccugagugcgaaucccuguucucuaauaagagcugguccuauauugccgagaccccgaacucugaaaauggcacauguuaccccggguauuuugccgauuacgaggagcuuagagaacaacugagcuccgugagcucuuucgagcgguuugaaaucuucccuaaagaguccagcuggcccaagcauaacguuaccaaaggagugacggcuucuugcucccacaagggcaaaagcucuuuuuaucgcaaucuccuguggcuuaccgagaagaacggcuccuacccuaaucugagcaaguccuaugucaacaauaaagaaaaggaggugcucguucuguggggagugcaucaccccucuaacaucgaagaccagaaaacaauuuacagaaaggagaacgccuacgucagcgugguguccagccacuauaaucggcgcuucaccccugaaaucgcgaaaagaccgaagguccggaaccaggaggggcgcauuaauuacuauuggacacugcucgagcccggcgauaccaucauuuuugaagccaacgggaaucugaucgcuccuugguacgccuucgcucuuucuagaggauuuggcuccgggauuaucacgagcaacgccucuauggacgagugugaugcgaaaugccagacaccccaaggagccaucaauagcucccugccuuuccagaacguucaucccgugaccauuggcgaauguccgaaguaugugcggucuacaaagcuccgcauggucaccggccugagaaauaucccuagcauucagucccgggggcuuuuuggagcuaucgccggcuucauugaagggggauggaccggcaugaucgacgggugguacggauaucaccaucagaacgagcaaggcagcggcuacgcugccgaucagaaaucuacacagaaugccaucaacgggauuacgaauaaggugaacuccaucauugagaaaaugaauacccaguuuacagcuguuggaaaggaguucaacaaacuggaaaagcgcauggagaaccucaauaagaaaguggacgauggcuuccuggacaucuggaccuacaacgcggaacugcucguccugcuugagaaugaaagaacacuggacuuucacgauagcaacgugaagaaucucuaugagaaaguuaagucucaacugaaaaacaaugccaaggagauugggaacggaugcuucgaauuuuaccacaaguguaauaacgagugcauggaauccgugaaaaauggcaccuaugacuaccccaaguauagcgaggaguccaaacuuaaccgggaaaagaucgauggggucaaacuggagucuaugggcguguaccagauccucgcuauuuauagcacggucgccuccucucuggugcugcucguuagccugggagccaucuccuucuggaugugcagcaauggcucucuucagugucgcauuugcaucuga

SEQ ID NO: 184437 - RNA, 1701 nt, Artificial Sequence; identical to SEQ ID NO: 183945
  derived and/or modified sequence opt5 from hemagglutinin__InfluenzaA__ABK40557

SEQ ID NO: 184438 - RNA, 1701 nt, Artificial Sequence; identical to SEQ ID NO: 183945
  derived and/or modified sequence opt5 from hemagglutinin__InfluenzaA__ABK40568

SEQ ID NO: 184439 - RNA, 1701 nt, Artificial Sequence; identical to SEQ ID NO: 183945
  derived and/or modified sequence opt5 from hemagglutinin__InfluenzaA__ABK40579

SEQ ID NO: 184440 - RNA, 1701 nt, Artificial Sequence
  derived and/or modified sequence opt5 from hemagglutinin__InfluenzaA__ABK40590
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaacauaauguuaccaagggagugacggcuucuugcucccacaaaggcaagagcucuuuuuaucgcaaccuccuguggcuuaccgagaagaauggcuccuacccuaaccugagcaaauccuaugucaauaacaaggaaaaagaggugcucguucuguggggagugcaucaccccucuaauaucgaagaccagaagacaauuuacagaaaagagaacgccuacgucagcgugguguccagccacuauaaccggcgcuucaccccugaaaucgcgaagagaccgaaaguccggaaucaggaggggcgcauuaacuacuauuggacacugcucgagcccggcgauaccaucauuuuugaagccaaugggaaccugaucgcuccuugguacgccuucgcucuuucuagaggauuuggcuccgggauuaucacgagcaaugccucuauggacgagugugaugcgaagugccagacaccccaaggagccaucaacagcucccugccuuuccagaauguucaucccgugaccauuggcgaauguccgaaguaugugcggucuacaaaacuccgcauggucaccggccugagaaacaucccuagcauucagucccgggggcuuuuuggagcuaucgccggcuucauugaagggggauggaccggcaugaucgacgggugguacggauaucaccaucagaaugaacaaggcagcggcuacgcugccgaucagaagucuacacagaacgccaucaaugggauuacgaacaaaguuaauuccaucauugagaagaugaacacccaguuuacagcugugggaaaagaguucaauaagcuggaaaagcgcauggagaaccucaacaaaaagguggacgauggcuuccuggacaucuggaccuacaaugcggaacugcucguccugcuugagaacgaaagaacacuggacuuucacgauagcaaugugaaaaaccucuaugagaagguuaaaaaucaacugaagaacaaugccaaggagauugggaacggaugcuucgaauuuuaccacaaauguaauaacgagugcauggaaucugugaagaauggcaccuaugacuaccccaaauauuccgaggagagcaaacuuaaccgggagaagaucgauggggucaagcuggaguccaugggcguguaccagauccucgcuauuuauucuacggucgccagcucccuggugcugcucguuucucugggagccaucagcuucuggaugugcuccaauggcagccuucagugucgcauuugcaucuga

SEQ ID NO: 184441 - RNA, 1701 nt, Artificial Sequence; identical to SEQ ID NO: 183945
  derived and/or modified sequence opt5 from hemagglutinin__InfluenzaA__ABK40601

SEQ ID NO: 184442 - RNA, 1701 nt, Artificial Sequence; identical to SEQ ID NO: 183674
  derived and/or modified sequence opt5 from hemagglutinin__InfluenzaA__ABK40612

SEQ ID NO: 184443 - RNA, 1701 nt, Artificial Sequence
  derived and/or modified sequence opt5 from hemagglutinin__InfluenzaA__ABK40623
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauugccuacggcgcgugucccagauaugugaagcagaacacacuuaaacuggccacgggcaugcggaaugucccugagaagcagacccgcgggaucuucggagcuauugccggcuuuaucgaaaacgggugggagggaaugguggacggcugguacggguucagacaucucaauagcgagggaacaggccaagcugccgaucugaaaucuacccaggccgcuauuaaccagaucaauggcaaacuuaaccggcugaucgaaaagacaaaugagaaguuucaccaaauugaaaaggaguucuccgaaguugaggggagaauccaggaccucgagaaauaugugaaggauaccaaaauugaccuguggagcuacaacgcggaacugcucgucgcccuggagaaccagcauacgaucgaucuuacagacucugaaaugaauaagcuguucgagcgcacccggaaacagcucagagaaaacgcugaggaugugggaaauggcugcuuuaagauuuaucacaagugugacaacgccugcaucggguccauucgcaauggaaccuacgaucacgacguuuaccgggaugaggcccugaacaauagauuccaaaucaaaggcguggaacuuaagagcggguauaaagacuggauccuguggauuuccuuugcuaucucuugcuuccuccugugugucgugcugcucggcuuuauuaugugggccugccagaagggaaacauccgcuguaauauuugcaucuga

SEQ ID NO: 184444 - RNA, 1701 nt, Artificial Sequence; identical to SEQ ID NO: 184008
  derived and/or modified sequence opt5 from hemagglutinin__InfluenzaA__ABK40645

SEQ ID NO: 184445 - RNA, 1701 nt, Artificial Sequence
  derived and/or modified sequence opt5 from hemagglutinin__InfluenzaA__ABK40656
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcccgacaggcagaauuugcgacucuccccaccggauccuggaugggaaaaauuguacccucaucgacgcccugcugggagauccucauugcgacggcuuucagaacaaggagugggaucucuucgucgaacgcuccaaagccuauagcaauuguuaccccuaugacgugccugauuacgcuucccugagaucucuuguugccagcuccgggacgcuggaguuuaccaacgaaaauuucaacuggacaggaguggcucaggacggcaagagcuauucuugcaagcggggcuccgucaauagcuuuuucucucgccucaacuggcugcacaaacuugaguacaaguaucccgcccugaaugugaccaugccuaacaaugggaaauuugauaagcucuacauuuggggaguucaucacccguccacagacagcgaucaaaccucucuguacgugagagcguccggcaaagucacggugagcacaaagcggucccagcagaccgugauccccgacauuggguaucgcccuugggucagaggacugucuagccggaucuccauuuacuggacaaucguuaagcccggcgacauucuccugaucaacagcaccgggaaccuuaucgccccucgcggauauuucaaaauuagaaauggcaagucuuccaucaugcggagcgaugcucccauuggcaacuguucuagcgagugcaucaccccgaauggguccauuccuaacgacaaacccuuucagaaugugaaccgcaucacauacggaacguguccuagauaugugaagcaaaauacccugaaacucgccacaggcaugcggaacguccccgaaaagcagacccgcgggaucuucggagcuauugccggcuuuaucgagaaugggugggaaggaaugguggauggcugguacggcuucagacaccagaacucugaggggacaggacaggcggccgaccugaaaagcacccaagcugccauugaucagaucaauggcaaacuuaaccggcugguugagaagacgaaugaaaaguuucaucagauugagaaggaguucuccgaaguggaagggagaauccaagaccucgagaaauaugucgaggauacaaagaucgaccuguggagcuacaacgcugaacugcucguggcccuggagaaucagcacaccauugaucuuaccgacucugaaaugaacaaacuguucgagcgcacacggaagcagcucagagaaaacgccgaggauaugggaaauggcugcuuuaagaucuaccauaaaugugacaacgcuugcauuggguccauccgcaauggcaccuaugaccacgauguuuaccgggacgaggcgcugaacaauagauuccagauuaagggaguggaacuuaaaagcggcuauaaggauuggauccuguggauuucuuuugccaucuccugcuuccuccugugugucgugcugcucggguuuaucaugugggcuugccaaaaaggaaacauucgcuguaauaucugcauuuga

SEQ ID NO: 184446 - RNA, 1701 nt, Artificial Sequence
  derived and/or modified sequence opt5 from hemagglutinin__InfluenzaA__ABK40667
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaagucuuaugccugcaagcggggguccgucaacagcuuuuucucucgccucaauuggcugcacaaacuugaguacaaguauccugcgcugaacgugaccaugcccaauaacgauaaauuugacaagcucuacauuuggggaguucaucacccuuccacagauagcgaccaaaccucucuguacgugcaggccuccggcagagucacggugagcacaaaacggucccagcagaccgugaucccgaauauugggucucgccccugggucagaggaaucagcucccggauuagcaucuauuggacaauuguuaagccuggcgacauccugcucaucaacucuaccgggaaccugauugcuccccgcggauacuucaagcugagaaauggcaaauccagcaucaugcggucugaugccccuauugacaacuguaauagcgagugcaucacccccaacggcuccauuccgaaugauaagccuuuucaaaacgugaaucgcaucacauauggggcuugucccagauacgugaaacagaacacgcugaagcucgccaccggaaugcggaaugucccugaaaaacagacacgcggcaucuucggggcgauugccggauuuaucgagaacggcugggaagggaugguggacggaugguauggcuucagacaccaaaauucugagggcaccgggcaggcugccgaucuuaagagcacacaggcugccauugaccagaucaacggaaaacuuaaucggcugaccgagaagacgaacgaaaaguuucaucaaauugagaaagaguucuccgaaguugaaggcagaauccaggaucucgagaaguacguggaggacacaaaaaucgaucuguggagcuauaaugccgaacugcucgucgcucuggagaaccagcacaccauugaccuuaccgauucugaaaugaacaagcuguucgagcgcacacggaaacagcucagagaaaaugcggaggacauggggaacggaugcuuuaagaucuaccauaagugugacaaugccugcauuggcuccauccgcaacgggaccuacaaucacgauguguaucgggacgaggcucugaacaauagauuccaaauuaaaggcguugaacuuaagagcggauacaaagauuggauccuguggauuucuuuugccaucuccugcuuccuccugugugugguccugcucggcuuuaucaugugggccugccagaaggggaacauucgcuguaauaucugcauuuga

SEQ ID NO: 184447 - RNA, 1701 nt, Artificial Sequence; identical to SEQ ID NO: 184090
  derived and/or modified sequence opt5 from hemagglutinin__InfluenzaA__ABK40678

SEQ ID NO: 184448 - RNA, 1698 nt, Artificial Sequence
  derived and/or modified sequence opt5 from hemagglutinin__InfluenzaA__ABK40689
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuagauucgcuuuugcccugucccggggguucggaagcggcaucauuaccucuaaugcucccauggaugaaugugacgccaagugccagacaccgcaaggcgcgaucaacuccagccuuccuuuucagaaugugcaccccgucaccaucggggaguguccuaaauaugugcgcucugccaagcugagaauggcuaccggacuccggaacauucccagcauccagucccgcggccuguucggggccauugcuggauuuaucgaaggcggguggacaggaaugguugauggcugguacggcuaucaucaccagaaugagcaagggucuggauacgccgccgaccagaaaagcacgcagaacgcuauuaauggcaucaccaacaaggucaauuccgugaucgaaaagaugaacacacaguucaccgcgguggggaaagaguucagcaaacuggagagacggauggaaaaucucaacaagaagguugaugacggauuucuggauauuuggacauacaacgccgagcuucuggugcuccuggaaaaugagcgcacccuugacuuccacgacucuaacgucaaaaaucuguaugaaaaggugaaaucccaacucaagaacaaugcuaaagagaucggcaacgggugcuuugaguucuaccauaaguguaaugaugaaugcauggagagcgucaagaacggcacguaugacuaccccaaauauucugaagaguccaagcugaauagagagaaaauugauggagugaagcuggaaagcaugggcguuuaccagauccucgccauuuauuccacaguggccucuagccugguccuucuggugucccucggggcuaucucuuuuuggaugugcagcaacggaucccugcagugucggaucugcauuuga

SEQ ID NO: 184449 - RNA, 1701 nt, Artificial Sequence; identical to SEQ ID NO: 183674
  derived and/or modified sequence opt5 from hemagglutinin__InfluenzaA__ABK40700

SEQ ID NO: 184450 - RNA, 1701 nt, Artificial Sequence; identical to SEQ ID NO: 183674
  derived and/or modified sequence opt5 from hemagglutinin__InfluenzaA__ABK40711

SEQ ID NO: 184451 - RNA, 1701 nt, Artificial Sequence
  derived and/or modified sequence opt5 from hemagglutinin__InfluenzaA__ABK40722
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauaacgaccagaucucccuguacgcccaggcuccggggcgcguuaccgugagcacgaagagaucccaacagacagucauucccaauaucggcucucggccuugggugcgcggggugagcuccagaauuagcaucuacuggaccauugucaaacccggagauauccugcucaucaacuguacaggcaaucugauugccccucggggguauuucaagauccgcucuggaaaguccagcauuaugagaucugacgcuagcaucggcaaaugcaacuccgaauguauuacccccaauggcucuaucccgaacgacaagccuuuucagaauguuaaccggaucaccuacggggccugcccccgcuaugugaaacagaauacacuuaagcuggcgacgggaaugagaaacgugccugagaaacaaacccggggcauuuucggggccaucgcuggauuuauugaaaauggcugggaggggauggucgauggaugguacggcuuccgccaccagaacagcgagggcacagggcaggccgcugaccucaaguccacccaagccgccaucaaucagauuaacggaaaacugaauagacuuaucgaaaagacaaacgagaaguuucaucagaucgaaaaagaguucagcgaaguggagggccggauucaggaucuggagaaguauguugaagacaccaaaaucgaucucuggucuuacaacgcugagcugcugguggcgcucgaaaaucaacacacgauugaccugacagauuccgagaugaacaaacuuuucgaaagaaccaagaagcagcugcgcgagaaugccgaggacauggggaacggauguuuuaagaucuaucauaaaugcgauaaugcuugcauuggcagcauccggaacgggaccuacgaccacgaugucuacagagacgaagcccucaauaaccgcuuccagauuaagggcguggagcugaaaucuggauauaaggacuggauccuuuggaucuccuuugccauuagcuguuuccugcucugcguugugcugcugggcuuuaucaugugggcuugucagaaagggaauauucggugcaacaucuguauuuga

SEQ ID NO: 184452 - RNA, 1701 nt, Artificial Sequence; identical to SEQ ID NO: 183674
  derived and/or modified sequence opt5 from hemagglutinin__InfluenzaA__ABK40733

SEQ ID NO: 184453 - RNA, 1701 nt, Artificial Sequence; identical to SEQ ID NO: 184329
  derived and/or modified sequence opt5 from hemagglutinin__InfluenzaA__ABK40744

SEQ ID NO: 184454 - RNA, 1701 nt, Artificial Sequence; identical to SEQ ID NO: 183939
  derived and/or modified sequence opt5 from hemagglutinin__InfluenzaA__ABK79948

SEQ ID NO: 184455 - RNA, 1698 nt, Artificial Sequence; identical to SEQ ID NO: 184228
  derived and/or modified sequence opt5 from hemagglutinin__InfluenzaA__ABK79959

SEQ ID NO: 184456 - RNA, 1701 nt, Artificial Sequence
  derived and/or modified sequence opt5 from hemagglutinin__InfluenzaA__ABK79970
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaaaagagcugguccuacaucgccgagaccccgaaucccaagaacggcacguguuauccuggguacuucgccgacuaugaagaacugcgggagcaacuuucuagcguguccagcuuugaacgcuucgagauuuuucccaaagauucuuccuggccuaaucauaccguuacaaagggagugaccgcuagcugcucucacaacggcaaauccagcuucuacaagaaucugcucuggcugacagagaaaaacggccuuuaucccaaucugucuaaguccuacgucaacaagaaagggaaggaggugcucguucuguggggagugcaucacccuagcaauaugggcgaccagagagccaucuaccacaaagagaacgcguaugucuccgugcugucuagccauuacucccggcgcuuuaccccggaaaucgccagacggcccaaggugcgcgaucaggaggggagaauuaacuauuacuggacgcuccuggaaccuggagacacaaucauuuucgaggcuaauggcaaccuuaucgcccccugguaugcuuuugcccugagccggggguucggaucuggcauuaucauuuccaaugcgagcaugggcgaaugugaugccaaaugccagaccccucaaggggcuaucaacucuagccuccccuuucagaauguccacccgguuacaaucggagaguguccuaaguacgugcgcuccaccaaacugagaauggugaccggccuucggaacguccccucuauucagagccgcgggcuguucggagccaucgcuggcuuuauugaagggggauggacaggcaugaucgacggcugguauggguaccaucaccagaaugaacaaggauccggcuacgccgccgaucaaaagagcacgcagaacgcuauuaaugggaucaccaacaagguuaauucuaucauugagaaaaugaacacacaguucaccgcggugggaaaggaguucaauaaacucgagagacggauggaaaaccugaauaagaaaguggacgauggcuuucuggacaucuggacauauaacgccgagcuccugguccuucuggagaacgaacgcacccucgacuuccacgauuccaaugugaagaaccuguacgagaagguuaaaaaucagcuuaagaacaaugcuaaagaaauugggaacggcugcuuugaguucuaucauaaguguaauaacgaaugcauggagagcgugaaaaauggaacguacgacuauccuaaguacucuaaggaguccaaacugaacagagaaaagaucgauggcgucaaacucgagagcauggggguguaucagauucuggccaucuacuccacagucgccucuagccuggugcuccugguuucccuuggagcuaucucuuuuuggaugugcagcaauggcucccugcagugucggauuugcaucuga

SEQ ID NO: 184457 - RNA, 1701 nt, Artificial Sequence
  derived and/or modified sequence opt5 from hemagglutinin__InfluenzaA__ABK79981
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcgggauuugcgacucuccgcaccagauccuggauggagagaauuguacgcucaucgacgcucugcugggcgauccccauugcgacggguuucagaacaaagaaugggaucucuucgucgagagaagcaaggccuauuccaauuguuacccuuaugacgugcccgauuacgccucucugcggagccuuguugcuuccagcggaacccuggaauuuaacaaugagucuuucaacuggacaggcguggcccaaaauggcaccuccagcgcuugcaaacgcagaucuaacaaguccuuuuucagccggcucaauuggcugcaccagcuuaaguauaaauacccugcccugaacgucacaaugcccaauaacgagaaguuugacaaacucuauauuuggggagugcaucacccuucuaccgauuccgaccagaucagccuguacgcgcaggccccggggcgcguuacgguguccacaaagagaucucaacagaccgucauucccaacaucggcagccggccuugggugcgcgggguguccagcagaauuucuaucuacuggacaauugucaaacccggagauauccugcucaucaauuguaccggcaaccugauugcuccucggggguauuucaagauccgcuccggaaagagcucuauuaugagaagcgacgccuccaucggcaaaugcaauucugaauguauuacccccaacggcagcaucccgaaugacaagccuuuucagaacguuaaucggaucacauacggggcuugcccccgcuaugugaaacagaacacgcuuaagcuggccaccggaaugagaaaugugccugagaaacaaacacggggcauuuucggggcgaucgccggauuuauugaaaacggcugggaggggauggucgauggaugguacggcuuccgccaccaaaauuccgagggcaccgggcaggcugccgaccucaagagcacacaggcugccaucaaccagauuaauggaaaacugaacagacuuaucgaaaagaccaaugagaaguuucaucagaucgaaaaagaguucucugaaguggagggccggauucaggaucuggagaaguauguugaagacacgaaaaucgaucucugguccuacaacgccgagcugcugguggcucucgaaaaccaacacacaauugaccugaccgauagcgagaugaauaaacuuuucgaaagaaccaagaagcagcugcgcgagaacgcggaggacauggggaauggauguuuuaagaucuaucauaaaugcgauaacgccugcauuggcucuauccggaaugggacauacgaccacgaugucuacagagacgaagcucucaacaaucgcuuccagauuaagggcguggagcugaaauccggauauaaggacuggauccuuuggaucagcuuugccauuuccuguuuccugcucugcguugugcugcugggcuuuaucaugugggccugucagaaagggaacauucggugcaauaucuguauuuga

SEQ ID NO: 184458 - RNA, 1701 nt, Artificial Sequence; identical to SEQ ID NO: 183674
  derived and/or modified sequence opt5 from hemagglutinin__InfluenzaA__ABK79992

SEQ ID NO: 184459 - RNA, 1701 nt, Artificial Sequence; identical to SEQ ID NO: 183945
  derived and/or modified sequence opt5 from hemagglutinin__InfluenzaA__ABK80025

SEQ ID NO: 184460 - RNA, 1701 nt, Artificial Sequence; identical to SEQ ID NO: 183945
  derived and/or modified sequence opt5 from hemagglutinin__InfluenzaA__ABK80036

SEQ ID NO: 184461 - RNA, 1701 nt, Artificial Sequence; identical to SEQ ID NO: 183945
  derived and/or modified sequence opt5 from hemagglutinin__InfluenzaA__ABK80047

SEQ ID NO: 184462 - RNA, 1701 nt, Artificial Sequence; identical to SEQ ID NO: 183790
  derived and/or modified sequence opt5 from hemagglutinin__InfluenzaA__ABK80058

SEQ ID NO: 184463 - RNA, 1701 nt, Artificial Sequence
  derived and/or modified sequence opt5 from hemagglutinin__InfluenzaA__ABK80069
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccuggaucagaggagugagcucucggauuuccaucuacuggacaaucgucaagccuggcgauauucugcucaucaacagcaccgggaaucugauugcccccagaggauauuucaaaaucagaucuggcaagagcuccauuaugcggucuaacgcuccuaucgggaaguguaauagcgaaugcaucacccccaacggauccauuccgaaugacaaaccuuuucagaacguuaaucgcaucgccuacggcgcgugucccagauaugugaagcagaacacacuuaaacuggccacgggcaugcggaaugugccugagaagcagacccgcgggauuuucggagcuaucgccggcuuuauugaaaacgggugggagggaauggucgacggcugguacggguucagacaucucaauagcgagggaacaggccaagcugccgaucugaaaucuacccaggccgcuaucaaccagaucaauggcaaacuuaaccggcugauugaaaagacaaaugagaaguuucaccaaaucgaaaaggaguucuccgaaguggaggggcgcauucaggaccucgagaaauauguugaagauaccaagaucgaccuguggagcuacaacgcggagcugcucguggcccuggaaaaccagcauacgauugaucuuacagacucugagaugaauaaacuguucgaacgcacccggaagcagcucagagagaacgcugaggaugucggaaauggcugcuuuaaaaucuaucacaagugugacaacgccugcauuggguccauccgcaauggaaccuacgaucacgacguguaccgggaugaagcccugaacaauagauuccaaaucaagggcguugagcuuaaaagcggguauaaggacuggauucuguggaucuccuuugcuauuucuugcuuccuccugugugugguccugcucggcuuuaucaugugggccugccagaaaggaaacauucgcuguaauaucugcaucuga

SEQ ID NO: 184464 - RNA, 1701 nt, Artificial Sequence
  derived and/or modified sequence opt5 from hemagglutinin__InfluenzaA__ABK80080
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgagaaaaccaaugaaaaguuucaccagauugaaaaggaguucuccgaaguugaggggagaauccaggaccuggagaaauauguggaagauacgaagauugaccucuggagcuacaacgcugagcugcuggucgcgcucgaaaaccagcauacaaucgaucugaccgacucugagaugaauaaacuuuucgaacgcacccggaagcaacugagagagaacgccgaggauaugggaaauggcugccucaaaauuuaucacaagugugacaacgcuugcaucggguccauucgcaauggaacauacgaucacgacguguaccgggaugaagcccugaacaauagauuucagaucaagggcguugagcuuaaaagcggguauaaggacuggauccuguggauuuccuucgccaucucuugcuuucuccugugugugguccugcucggcuucauuaugugggcuugccagaaaggaaacauccgcuguaauauuugcaucuga

SEQ ID NO: 184465 - RNA, 1701 nt, Artificial Sequence; identical to SEQ ID NO: 183674
  derived and/or modified sequence opt5 from hemagglutinin__InfluenzaA__ABK80091

SEQ ID NO: 184466 - RNA, 1701 nt, Artificial Sequence; identical to SEQ ID NO: 183674
  derived and/or modified sequence opt5 from hemagglutinin__InfluenzaA__ABK80102

SEQ ID NO: 184467 - RNA, 1701 nt, Artificial Sequence; identical to SEQ ID NO: 183075
  derived and/or modified sequence opt5 from hemagglutinin__InfluenzaA__ABK80113

SEQ ID NO: 184468 - RNA, 1701 nt, Artificial Sequence
  derived and/or modified sequence opt5 from hemagglutinin__InfluenzaA__ABK80124
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagaauacacuuaagcuggcuacgggaaugcggaacguccccgagaaacaaacccgcggcauuuucggggccaucgcgggauuuauugaaaauggcugggaggggaugauggacggaugguacggcuucagacaccagaacuccgagggcacagggcaggccgcugaucucaagagcacccaagccgcuaucaaucagauuaacggaaaacugaaucggcuuaucgaaaagacaaacgagaaguuucaucagaucgaaaaagaguucucugaaguggagggccgcauucaggaccuggagaaguauguugaagauaccaaaaucgaccucugguccuacaaugccgagcugcugguggcccucgaaaaccaacacacgauugaucugacagacagcgagaugaacaaacuuuucgaaagaaccaagaagcagcugcgggagaaugcugaggauauggggaacggaugcuuuaagaucuaucauaaaugugacaaugcgugcauuggcucuaucagaaacgggaccuacgaucacgacgucuaccgcgacgaagcccucaauaaccgguuccagauuaagggcguggagcugaaauccggauauaagaauuggauccuuuggaucagcuuugcuauuuccugcuuccugcucuguaucguucugcugggcuuuauuaugugggccugccagaaagggaacaucagauguaauauuugcaucuga

SEQ ID NO: 184469 - RNA, 1701 nt, Artificial Sequence; identical to SEQ ID NO: 183075
  derived and/or modified sequence opt5 from hemagglutinin__InfluenzaA__ABK80135

SEQ ID NO: 184470 - RNA, 1701 nt, Artificial Sequence; identical to SEQ ID NO: 183075
  derived and/or modified sequence opt5 from hemagglutinin__InfluenzaA__ABK80146

SEQ ID NO: 184471 - RNA, 1701 nt, Artificial Sequence; identical to SEQ ID NO: 183075
  derived and/or modified sequence opt5 from hemagglutinin__InfluenzaA__ABK80157

SEQ ID NO: 184472 - RNA, 1701 nt, Artificial Sequence; identical to SEQ ID NO: 183586
  derived and/or modified sequence opt5 from hemagglutinin__InfluenzaA__ABK80168

SEQ ID NO: 184473 - RNA, 1701 nt, Artificial Sequence
  derived and/or modified sequence opt5 from hemagglutinin__InfluenzaA__ABK80179
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcgugccgaacgauaagccuuuucagaaugugaaccgcaucaccuacggggcuugucccagauaugucaaacagaauacacuuaagcuggccacgggaaugcggaacgugccugagaaacaaacccgcggcaucuucggggcgauugccggauuuaucgaaaauggcugggaggggaugauggacggaugguacggcuucagacaccagaacuccgagggcacagggcaggcugccgaucucaagagcacccaagcugccauuaaucagaucaacggaaaacugaaucggcuuauugaaaagacaaacgagaaguuucaucagaucgaaaaagaguucucugaaguugagggcagaauccaggaccuggagaaguauguggaagauaccaaaauugaccucugguccuacaaugccgagcugcuggucgcucucgaaaaccaacacacgaucgaucugacagacagcgagaugaacaaacuuuucgaacgcaccaagaagcagcugcgggagaaugcggaggauauggggaacggaugcuuuaagauuuaucauaaaugugacaaugccugcaucggcucuauuagaaacgggaccuacgaucacgacguguaccgcgacgaagcucucaauaaccggcugcagaucaagggcguugagcuuaaauccggauauaaggauuggauucuguggaucagcuucgccaucuccugcuuucuccuguguauugugcugcucggcuucaucaugugggccugccagaaagggaauauuagauguaacaucugcauuuga

SEQ ID NO: 184474 - RNA, 1701 nt, Artificial Sequence; identical to SEQ ID NO: 183586
  derived and/or modified sequence opt5 from hemagglutinin__InfluenzaA__ABK80190

SEQ ID NO: 184475 - RNA, 1701 nt, Artificial Sequence; identical to SEQ ID NO: 184329
  derived and/or modified sequence opt5 from hemagglutinin__InfluenzaA__ABK80201

SEQ ID NO: 184476 - RNA, 1701 nt, Artificial Sequence
  derived and/or modified sequence opt5 from hemagglutinin__InfluenzaA__ABK80212
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaaaauuggauucuguggaucagcuuugccauuuccugcuuccuucuguguguggcccuccugggguuuaucaugugggcuugccagaagggaaacauuagauguaauaucugcaucuga

SEQ ID NO: 184477 - RNA, 1701 nt, Artificial Sequence; identical to SEQ ID NO: 183540
  derived and/or modified sequence opt5 from hemagglutinin__InfluenzaA__ABK80223

SEQ ID NO: 184478 - RNA, 1701 nt, Artificial Sequence
  derived and/or modified sequence opt5 from hemagglutinin__InfluenzaA__ABK80234
augagaaccaucauugcccugagcuacauccucugccugguguucgcucagaagcugcccggcaacgacaauuccacagccacgcugugucucgggcaccaugcggucccuaacggaaccauuguuaaaacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaagaaaugggaucuguucgucgaacggagcaaggccuauuccaauuguuacccuuaugacgugcccgaucaugcuucucuccgcagccugguugccuccagcggaacgcuugaguuuaacaaugaaucuuucgacuggaccggcgugacacagaacggcaccuccagcgcuugcaaaagacggucuaauaaguccuuuuucagccgccugaacuggcucacacaccugaaguacaaauauccugcccuuaaugucaccaugcccaacaaugagaaguuugauaaacuguacaucuggggagugcaucacccugggacggacucugaucagauuucccucuaugcgcaggccagcggcagaaucacaguuuccaccaagcggucucaacagacagugauuccgaacaucgggagccgccccagaguccgggacguguccagccgcauuucuaucuacuggaccaucgugaaaccuggagacauucugcugaucaacuccaccggcaaucucauugcucccagaggguacuucaagauccggagcggaaagucuagcauuaugcgcuccgaugccccuaucggcaaauguaacucugagugcaucacacccaauggcagcauuccgaacgacaagccuuuucagaaugucaacagaaucacguauggggcuuguccccgguacguuaaacagaauacccugaaacuugccacaggaaugcgcaacgugccugaaaaacaaaccagaggcauuuucggggcgaucgccggauuuauugagaauggcugggaagggaugguggauggaugguauggcuuccggcaccagaacuccgagggcacagggcaggcugccgaccuuaagagcacccaagcugccaucaaucagaucaacggaaaacucaauagacugauuggcaagacgaacgagaaguuucaucagaucgaaaaagaguucucugaagucgaggggcgcauucaggaucuugaaaaguacguggaggacacaaaaaucgaucugugguccuauaaugccgagcuccugguugcucuggaaaaccaacacaccauugaccucaccgauagcgagaugaacaagcuguucgaacggacaaagaagcagcuuagagagaaugcggaagacaugggaaacggcugcuuuaagaucuaccauaaaugugauaaugccugcauugggucuauccgcaacggcaccuaugaccacgacguguaccgggaugaggcucugaauaacagauuccagaucaagggagucgagcucaaauccggcuacaaggacuggauucuguggaucagcuuugccauuuccugcuuccuucuguguguggcccuccugggguuuaucaugugggcuugccagaaaggaaauauucgcuguaacaucugcaucuga

SEQ ID NO: 184479 - RNA, 1701 nt, Artificial Sequence
  derived and/or modified sequence opt5 from hemagglutinin__InfluenzaA__ABK80245
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagcccauuccaauuguuauccuuacgacgugcccgauuaugcuucucuccggagccugaucgccuccagcggaacgcuugaguuuaacaaugaaucuuucaacuggaccggcguuacacagaauggcaccuccagcgcuugcaagcgcagaucuaaccaguccuuuuucagccggcugaauuggcucacacaccugaaguuuaaauacccugcccuuaacgugaccaugcccaauaacgagaaguucgacaaacuguauauuuggggaguccaucacccugggacggauucugaccagaucucccucuacgcgcaagccccgggccgcauuacagugagcaccaagagaucccagcagacaguuauccccaacauugggucucggccucgcgugagagauaucagcucccggaucagcauuuauuggaccaucgucaaacccggagacauucugcugaucaauucuaccggcaaccucauugcuccucgcggguacuuuaagaucagauccggaaagagcucuaucaugaaaagcgacgcccccauuggcaaguguaauuccgagugcaucacaccgaacggcucuauuccuaaugauaaacccuuccagaacgugaaucggaucacguacggggcuuguccucgcuaugugaagcaaaacacccugaaacuugccacaggaaugagaaauguccccgaaaagcagacccggggcauuuuuggggcgaucgccggauucaucgagaacggcugggaagggaugguugacggaugguacggcuuucgccaccagaauagcgagggcacagggcaagcugccgaucugaaauccacccaggcugccauuaaccagaucaauggaaagcucaacagacugauuggcaagacgaaugagaaauuccaucagaucgaaaaggaguucagcgaaguggaggggcggauucaagaccuugaaaaauauguggaggauacaaagaucgaccuguggucuuacaacgccgagcuccuggucgcucuggaaaaccagcacaccauugaucucaccgacuccgagaugaauaaacuguuugaaagaacaaagaagcagcuucgcgagaacgcggaagauaugggaaauggcugcuucaaaaucuaucauaagugugacaacgccugcaucgggagcauucggaauggcaccuacgaucacgacguguauagagacgaggcucugaacaaucgcuuucagaucaaaggaguugagcucaagucuggcuacaaagauuggauucuguggaucuccuucgccauuagcugccuucugcucuguguggcccugcugggguuuaucaugugggcuugccaaaagggaaacauccgguguaauauuugcaucuga

SEQ ID NO: 184480 - RNA, 1701 nt, Artificial Sequence; identical to SEQ ID NO: 184479
  derived and/or modified sequence opt5 from hemagglutinin__InfluenzaA__ABK80256

SEQ ID NO: 184481 - RNA, 1701 nt, Artificial Sequence; identical to SEQ ID NO: 183636
  derived and/or modified sequence opt5 from hemagglutinin__InfluenzaA__ABK80267

SEQ ID NO: 184482 - RNA, 1701 nt, Artificial Sequence; identical to SEQ ID NO: 183657
  derived and/or modified sequence opt5 from hemagglutinin__InfluenzaA__ABK80278

SEQ ID NO: 184483 - RNA, 1701 nt, Artificial Sequence
  derived and/or modified sequence opt5 from hemagglutinin__InfluenzaA__ABK80289
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaaacaaacccgcggcaucuucggggcgauugccggauuuaucgagaauggcugggaagggaugguggauggaugguauggcuucagacaccagaacuccgagggcacagggcaggcugccgaccugaagucuacccaagcugccaucaaucagauuaacggaaaacucaaccggcugaucggcaagacgaaugagaaguuccaccagauugaaaaagaguuuagcgaaguggaggggagaauccaggaucuugaaaaguacgucgaggacacaaaaauugaucugugguccuauaacgccgagcuccugguggcucuggaaaaucaacauaccaucgaccucaccgauagcgagaugaacaagcuguucgaacgcacaaagaagcagcuucgggagaaugcggaagacaugggaaacggcugcuuuaagauuuaccacaaaugugauaaugccugcaucgggucuaucagaaacggcaccuaugaccaugauguuuaccgcgacgaggcucugaauaaccgguuccagauuaagggaguggagcucaaauccggcuacaaggacuggauccuguggauuagcuuugccaucucuugcuuccuucugugugucgcccuccugggguuuauuaugugggcuugccagaaaggaaauaucagauguaacaucugcauuuga

SEQ ID NO: 184484 - RNA, 1701 nt, Artificial Sequence; identical to SEQ ID NO: 183075
  derived and/or modified sequence opt5 from hemagglutinin__InfluenzaA__ABK80300

SEQ ID NO: 184485 - RNA, 1701 nt, Artificial Sequence; identical to SEQ ID NO: 183075
  derived and/or modified sequence opt5 from hemagglutinin__InfluenzaA__ABK80311

SEQ ID NO: 184486 - RNA, 1707 nt, Artificial Sequence
  derived and/or modified sequence opt5 from hemagglutinin__InfluenzaA__ABL07019
auggagaagaucgugcugcuccugagcauugucucccuuguuaaaucugaccagaucugcauuggcuaccacgccaacaauagcaccgaacaaguggauacaaucauggagaagaacgugacggucacccaugcucaggacauucuggaaaagacacacaaugggaagcucugugaucuggacggagugaaaccccuuauccugagagauugcuccguugccggcuggcuccuggggaacccuaugugugacgaguucaucaaugugccggaauggucuuauauugucgagaaggcgaaccccaccaaugaucugugcuacccuggcagcuuuaacgacuaugaggaacucaagcaucugcuuucccggaucaaucacuucgagaaaauucagaucauucccaagucuagcugguccgaucaugaagcuagcucuggaguguccagcgccuguccuuaccuggggucucccuccuuuuuccgcaacguuguguggcucaccaaaaagaauagcacauauccuacaaucaaaaagucuuacaacaauaccaaccaggaggaccugcuuguccuguggggcauucaccacccgaauaacgaggccgaacaaacgagacucuaucagaaccccaccacauacaucuccaucggaaccagcacacugaaucagcggcuggugccuaagauugcuacccgcuccaaagugaacggccagucugggagaauggaguuuuucuggacgauccucaagcccaaugaugccauuaacuuugaaagcaauggaaacuucaucgcuccugaguacgccuauaaaauugucaagaaaggcgacuccgcgaucaugaaaagcgaacuggaguacucuaauugcaacacaaaaugucaaacccccaugggggccaucaauuccagcaugccguuucauaacauucacccucuuacaaucggagagugccccaaguauguuaagucuaaucggcuggugcucgcuaccggccugcgcaacagcccucagagagaaucccggcgcaaaaagagagggcuuuucggagccauugcuggcuuuaucgagggcggguggcagggaaugguggauggcugguacggguaucaucacucuaaugaacagggaagcggcuacgccgcggacaaagaguccacccaaaaggccauugacggggucacaaacaaagugaauagcaucaucgauaagaugaacacgcaguucgaagcuguuggacgggaguuuaacaaucuggagcgcagaauugaaaaccucaauaagaaaauggaggacggcuuccuggauguguggaccuauaacgccgaacugcucguccugauggagaaugaacggacacuugacuuccacgauucuaacgugaagaaucuguacgacaaaguucgccuccagcugagagauaacgcuaaggagcuuggcaauggguguuuugaguucuaccauaaaugcgacaacgaauguauggaguccauccggaauggaaccuauaacuacccccaauauagcgaagaggccagacugaagcgcgaggaaauuucuggcgugaagcucgaguccaucgggacauaccagauucugagcaucuauuccaccgucgccucuagccuggcucucgcgauuaugaucgccggacugucccuuuggaugugcucuaauggcagccugcagugccggaucuguauuuga

SEQ ID NO: 184487 - RNA, 1707 nt, Artificial Sequence
  derived and/or modified sequence opt5 from hemagglutinin__InfluenzaA__ABL07030
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucugggccauucucaagcccaacgacgcgaucaauuuugagucuaacggaaauuucauugccccugaauacgcuuauaaaaucgucaagaaaggcgauagcgccaucaugaaguccgagcuggaauacgggaacugcaauaccaaaugucaaacgcccaugggagcuauuaacagcucuaugccguuucauaauauccacccucuuacaauuggcgagugccccaaguauguuaaguccaaccggcuggugcucgccaccgggcugcgcaauagcccucagagagagucucggcgcaaaaagagaggacuuuucggcgcgaucgccggcuuuauugaagggggauggcagggcaugguggacgggugguacggauaucaucacagcaacgagcagggcuccggguacgcugccgacaaagaaucuacacaaaaggcuaucgauggagucaccaauaaagugaacagcaucauugacaagaugaauacccaguucgaggccguuggccgggaauuuaacaaccuggagcgcagaaucgagaaucucaacaagaaaauggaagauggcuuccuggacguguggacauauaaugccgagcugcucguccugauggaaaacgagcggacgcuugauuuccacgacuccaaugugaagaaccuguacgauaaaguucgccuccagcugagagacaaugcuaaggaacuugggaacggauguuuugaguucuaccauaaaugcgauaaugaguguauggaaagcauucggaacggcaccuauaauuacccccaauauucugaggaagcgagacugaagcgcgaggagaucuccggggugaagcucgaaagcauuggaacauaccagauccugucuauuuauuccaccgucgccagcucccuggcucucgccaucaugaucgccggccugucucuuuggaugugcagcaacgggucccugcagugccggauuuguaucuga

SEQ ID NO: 184488 - RNA, 1707 nt, Artificial Sequence
  derived and/or modified sequence opt5 from hemagglutinin__InfluenzaA__ABL10088
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccgaaguuaauggccaaagcgggcggauggaguucuuuuggacaauccugaaaccuaacgacgccauuaauuucgaauccaacggaaauuuuguggcgcccgaguacgccuauaagaucgugaaaaagggcgauucuaccauuaugaaaagcgaacucgaguacgggaacugcaauacgaagugucagacaccuaugggagcuaucaacuccagcaugcccuuccauaauauccacccgcugaccauuggcgagugcccuaaauaugucaagucuaaccgccuugugcuggccacagggcucagaaauagcccccagcgggaacgcagacggaagaaacgcggacuguuuggcgcuaucgccggcuucauugaagggggauggcagggcaugguugacgggugguacggauaucaucacuccaacgaacaaggcucuggguacgcggccaauaaggagagcacccagaaagcuaucgacggagugaccaacaaggucaauuccauuaucgauaaaaugaacacacaguuugaagccgugggcagagaguucaacaaucuugagcggcgcaucgaaaaccugaauaagaagauggaggacggcuuccucgauguuuggacguauaacgcugaacugcuggugcucauggagaaugaaagaacccuggacuuucacgauucuaacgucaaaaaucuuuacgacaaggugcggcugcaacucagagauaacgccaaagagcuggggaauggauguuucgaguuuuaccauaagugcgacaacgaauguauggagagcguccgcaauggcacauaugauuacccucaguauuccgaagaggcccggcuuaaaagagaggaaauuagcggggugaagcuggagucuaucggaauuuaccagauccucuccauuuauagcaccguugcuucuucccuggcgcuggccaucaugguggcuggccucagccuguggaugugcuccaacgggucucuucagugccgcauuuguaucuga

SEQ ID NO: 184489 - RNA, 1707 nt, Artificial Sequence
  derived and/or modified sequence opt5 from hemagglutinin__InfluenzaA__ABL31766
auggagaagaucgugcugcuccuggccauugucagcuucguuaaauccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaauuuaucaaugugccggaaugguccuauauugucgagaaggcuaaccccaccaaugaucugugcuacccuggaucuuucaacgacuaugaggaacugaagcaucuccugagccggaucaaucacuuugagaaaauucagaucauucccaaguccucuuggagcgaucaugaagccuccagcggcgugucuuccgccuguccuuaccuugggagccccucuuucuuucgcaacguuguguggcugaucaaaaagaacuccacauauccuaccauuaaaaagagcuacaauaauacaaaccaggaggaccuccugguccuuuggggaauccaccacccgaaugaugcugccgagcaaaccagacuguaucagaaccccacgaccuacaucucuauuggcacauccacccucaaccagcggcuggugccuaagaucgcuacacgcagcaaagugaauggccaguccgggagaauggaguucuuuugggccauucugaagcccaacgacgcgaucaauuucgaaucuaacggaaauuuuauugccccugaauacgcuuauaaaaucgucaagaaaggcgauagcgccaucaugaaguccgagcucgaauacgggaacugcaauaccaaaugucaaacgcccaugggagcuauuaacagcucuaugccguuccauaauauccacccucugacaauuggcgagugccccaaguauguuaaguccaaccggcuugugcuggccaccgggcuccgcaauagcccucagagagagucucggcgcaaaaagagaggacuguuuggcgcgaucgccggcuucauugaagggggauggcagggcaugguggacgggugguacggauaucaucacagcaacgagcagggcuccggguacgcugccgacaaagaaucuacacaaaaggcuaucgauggagucaccaauaaagugaacagcaucauugacaagaugaauacccaguuugaggccguuggccgggaguucaacaaccuugaacgcagaaucgagaaucugaacaagaaaauggaagauggcuuccucgacguguggacauauaaugccgagcugcugguccucauggaaaacgagcggacgcuggauuuucacgacuccaaugugaagaaccuuuacgauaaaguucgccugcagcucagagacaaugcuaaggaacuggggaacggauguuucgaguuuuaccauaaaugcgauaaugaguguauggaaagcauucggaacggcaccuauaauuacccccaauauucugaggaagcgagacuuaagcgcgaggagaucuccggggugaagcuggaaagcauuggaacauaccagauccucucuauuuauuccaccgucgccagcucccuggcucuggccaucaugaucgccggccucucucuguggaugugcagcaacgggucccuucagugccggauuuguaucuga

SEQ ID NO: 184490 - RNA, 1707 nt, Artificial Sequence
  derived and/or modified sequence opt5 from hemagglutinin__InfluenzaA__ABL31780
auggagaagaucgugcugcuccugagcauugucucccuuguuaaaucugaccagaucugcauuggcuaccacgccaacaauagcaccgaacaaguggauacaaucauggagaagaacgugacggucacccaugcucaggacauucuggagaaaacacacaaugggaagcucugugaucuggacggagugaaaccccuuauccugagagauugcuccguugccggcuggcuccuggggaacccuaugugugacgaguucaucaaugugccggaauggucuuauauugucgagaaggcgaaccccaccaaugaucugugcuacccuggaucuuuuaacgacuaugaggaacucaagcaucugcuuucccggaucaaucacuucgagaaaauucagaucauucccaagggcucuuggagcgaucaugaggcuuccagcggggugucuuccgccuguccuuaccugcgcagccccagcuuuuucagaaacguuguguggcucaucaaaaagaacuccacauauccuaccauuaaaaagagcuacaauaauacaaaccaggaagaccugcuuguccuguggggaauccaccacccgaauaacgaggccgaacaaacccggcucuaucagaaccccacgaccuacaucucuauuggcacauccacccugaaucagcgccuggugccuaagaucgcuacaagaagcaaagugaacggccaguccgggcggauggaguuuuucuggaccauucucaagcccaaugaugccaucaacuuugaaucuaauggaaacuucauugcuccugaguacgccuauaaaaucgucaagaaaggcgacagcgcgaucaugaaguccgaacuggaguacgggaauugcaacacgaaaugucaaacacccaugggagccauuaauagcucuaugccguuucauaacauccacccucuuaccauuggcgagugccccaaguauguuaaguccaaucgccuggugcucgcuacagggcugagaaacagcccucagcgggaaucucgccggaaaaagagaggacuuuucggcgccaucgcuggcuuuauugaagggggauggcagggcaugguggaugggugguacggauaucaucacagcaaugaacagggcuccggguacgccgcggacaaagagucuacccaaaaggccaucgacggagucaccaacaaagugaauagcaucauugauaagaugaacacacaguucgaagcuguuggccgcgaguuuaacaaucuggagagacggaucgaaaaccucaauaagaaaauggaggacggcuuccuggauguguggacguauaacgccgaacugcucguccugauggagaaugaacgcacccuugacuuccacgauuccaacgugaagaaucuguacgacaaaguuagacuccagcugcgggauaacgcuaaggagcuugggaauggauguuuugaguucuaccauaaaugcgacaacgaauguauggagagcauuagaaauggcacauauaacuacccccaauauucugaagaggcccgccugaagcgggaggaaaucuccggggugaagcucgagagcauuggaaccuaccagauccugucuauuuauuccacagucgccagcucccuggcucucgcgaucaugaucgccggccugucucuuuggaugugcagcaaugggucccugcagugcagaauuuguaucuga

SEQ ID NO: 184491 - RNA, 1701 nt, Artificial Sequence
  derived and/or modified sequence opt5 from hemagglutinin__InfluenzaA__ABL67165
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaucuggcaucugcgacagcccgcaccagauccuugauggggagaauuguacccugauugacgcccuccugggagauccccagugcgacggcuuucaaaacaaaaagugggaucuguucgucgaaagauccaaagccuauucuaauuguuacccuuaugacgugcccgaucaugcuagccuccggucccugguugccagcucugggacgcuugaguuuaacaaugaauccuucgacuggaccggagugacacagaacggcaccagcucugcuugcaagcgcagauccaauaagagcuuuuucucucggcugaacuggcucacacaccugaaauacaaguauccugcccuuaaugucaccaugcccaacaaugagaaauuugauaagcuguacaucuggggcgugcaucacccugggacggacuccgaucagauuagccucuaugcgcaggccuccggacgcaucacaguuucuaccaaaagaagccaacagacagugauuccgaacaucggcucccggccccgcgucagagacgugagcucucggauuuccaucuacuggaccaucgugaagccuggggacauucugcugaucaacagcaccggaaaucucauugcuccccgcggcuacuucaagaucagaucugggaaaagcuccauuaugcggucugaugccccuaucggaaaguguaacagcgagugcaucacacccaauggcuccauuccgaacgacaaaccuuuucagaaugucaaccgcaucacguauggcgcuugucccagauacguuaagcagaauacccugaaacuugccacagggaugcggaacgugccugaaaagaaaacccgcggaauuuucggcgcgaucgccggguuuauugagaauggaugggaaggcaugguggaugggugguauggauucagacaccaaaacagcgagggcacaggccaggcugccgaccugaagucuacccaggcugccaucaaucaaaucaacgggaagcucaaucggcugauuggaaaaacgaacgagaaguuucaucagaucgaaaaagaguucuccgaagucgagggccgcauucaggaucuugaaaaguacguggaggacacaaaaaucgaucuguggagcuauaaugccgagcuccugguugcucuggaaaaccagcacaccauugaccucaccgauucugagaugaacaagcuguucgaaagaacaaagaaacaacuucgggagaaugcggaagacauggggaacggaugcuuuaagaucuaccauaaaugugauaaugccugcauuggcuccaucagaaacgggaccuaugaccacgacguguaccgcgaugaggcucugaauaaccgguuccagaucaagggcgucgagcucaaaagcggauacaaggacuggauucuguggaucuccuuugccauuucuugcuuccuucuguguguggcccuccugggcuuuaucaugugggcuugccagaaggggaauauuagauguaacaucugcaucuga

SEQ ID NO: 184492 - RNA, 1701 nt, Artificial Sequence
  derived and/or modified sequence opt5 from hemagglutinin__InfluenzaA__ABL67176
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcgggauuugcgacucuccgcaccagauccuggauggagagaauuguacgcucaucgacgcucugcugggcgauccccauugcgacggguuucagaacaaagaaugggaucucuucgucgagagaagccgggccuauuccaauuguuacccuuaugacgugcccgauuacgccucucugcgcagccuuguugcuuccagcggaacccuggaauuuaacaaugagucuuucaacuggacaggcguggcccaaaauggcaccuccagcgcuugcaagagacggucuaacaaauccuuuuucagccgccucaauuggcugcaccagcuuaaguauaaguacccugcccugaacgucacaaugcccaauaacgagaaauuugacaagcucuauauuuggggagugcaucacccuucuaccgauuccgaccagaucagccuguacgcgcaggccccggggagaguuacgguguccacaaaacggucucaacagaccgucauucccaacaucggcagccgcccuugggugagagggguguccagccggauuucuaucuacuggacaauugucaagcccggagauauccugcucaucaauuguaccggcaaccugauugcuccucgcggguauuucaaaaucagauccggaaagagcucuauuaugcggagcgacgccuccaucggcaagugcaauucugaauguauuacccccaacggcagcaucccgaaugacaaaccuuuucagaacguuaaucgcaucacauacggggcuugccccagauaugugaagcagaacacgcuuaaacuggccaccggaaugcggaaugugccugagaagcaaacacgcggcauuuucggggcgaucgccggauuuauugaaaacggcugggaggggauggucgauggaugguacggcuucagacaccaaaauuccgagggcaccgggcaggcugccgaccucaaaagcacacaggcugccaucaaccagauuaauggaaagcugaaccggcuuaucgagaaaaccaaugaaaaguuucaucagaucgaaaaggaguucucugaaguggagggccgcauucaggaucuggagaaauauguugaagacacgaagaucgaucucugguccuacaacgccgagcugcugguggcucucgaaaaccaacacacaauugaccugaccgauagcgagaugaauaaacuuuucgaaagaaccaagaaacagcugcgggagaacgcggaggacauggggaauggauguuuuaagaucuaucauaagugcgauaacgccugcauuggcucuaucagaaaugggacauacgaccacgaugucuaccgcgacgaagcucucaacaaucgguuccagauuaaaggcguggagcugaaguccggauauaaagacuggauccuuuggaucagcuuugccauuuccuguuuccugcucugcguugugcugcugggcuuuaucaugugggccugucagaaggggaacauuagaugcaauaucuguauuuga

SEQ ID NO: 184493 - RNA, 1701 nt, Artificial Sequence; identical to SEQ ID NO: 184456
  derived and/or modified sequence opt5 from hemagglutinin__InfluenzaA__ABL67187

SEQ ID NO: 184494 - RNA, 1701 nt, Artificial Sequence; identical to SEQ ID NO: 184411
  derived and/or modified sequence opt5 from hemagglutinin__InfluenzaA__ABL67209

SEQ ID NO: 184495 - RNA, 1701 nt, Artificial Sequence; identical to SEQ ID NO: 183945
  derived and/or modified sequence opt5 from hemagglutinin__InfluenzaA__ABL67253

SEQ ID NO: 184496 - RNA, 1701 nt, Artificial Sequence
  derived and/or modified sequence opt5 from hemagglutinin__InfluenzaA__ABL67264
augaaggccaagcugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaacauaauguuaccaagggagugacggcuucuugcucccacaaaggcaagagcucuuuuuaucgcaaccuccuguggcuuaccgagaagaauggcuccuacccuaaccugagcaaauccuaugucaauaacaaggaaaaagaggugcucguucuguggggagugcaucaccccucuaauaucgaagaccagaagacaauuuacagaaaagagaacgccuacgucagcgugguguccagccacuauaaccggcgcuucaccccugaaaucgcgaagagaccgaaaguccggaaucaggaggggcgcauuaacuacuauuggacacugcucgagcccggcgauaccaucauuuuugaagccaaugggaaccugaucgcuccuugguacgccuucgcucuuucuagaggauuuggcuccgggauuaucacgagcaaugccucuauggacgagugugaugcgaagugccagacaccccaaggagccaucaacagcuccuucccuuuucagaauguucaucccgugaccauuggcgaauguccgaaguaugugcggucuacaaaacugcgcauggucaccggccucagaaacaucccuagcauucagucccgggggcuguucggagcuaucgccggcuuuauugaagggggauggaccggcaugaucgacgggugguacggauaucaccaucagaaugaacaaggcagcggcuacgcugccgaucagaagucuacacagaacgccaucaaugggauuacgaacaaaguuaauuccaucauugagaagaugaacacccaguucacagcugugggaaaagaguucaauaaacuugaaaagcgcauggagaaccugaacaaaaagguggacgauggcuuucucgacaucuggaccuacaaugcggaacugcugguccuccuggagaacgaaagaacacuugacuuccacgauagcaaugugaaaaaccuguaugagaagguuaaaucucaacucaagaauaacgccaaggagauugggaauggaugcuuugaguucuaccacaaauguaacaaugagugcauggaauccgugaagaacggcaccuaugacuaccccaaauauagcgaggaguccaagcugaaucgggaaaagaucgauggggucaaacuugagucuaugggcguguaccagauccuggcuauuuauagcacggucgccuccucucucgugcugcugguuagccucggagccaucuccuuuuggaugugcagcaacggcucucugcagugucgcauuugcaucuga

SEQ ID NO: 184497 - RNA, 1701 nt, Artificial Sequence
  derived and/or modified sequence opt5 from hemagglutinin__InfluenzaA__ABL67275
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgaaaagaccaaugagaaguuucaccagauugaaaaggaguucuccgaaguugaggggagaauccaggaccuggagaaauauguggaagauacgaagauugaccucuggagcuacaacgcugagcugcuggucgcgcucgaaaaccagcauacaaucgaucugaccgacucugagaugaauaaacuuuucgaacgcacccggaagcaacugagagagaacgccgaggaugugggaaauggcugcuuuaaaauuuaucacaagugugacaacgcuugcaucggguccauucgcaauggaacauacgaucacgacguuuaccgggaugaagcccucaacaauagauuccagaucaagggcgugaaacugaaaagcggguauaaagacuggauccuuuggauuuccuuugccaucucuugcuuccugcucugugucgugcugcugggcuuuauuaugugggcuugccagaagggaaacauccgcuguaauauuugcaucuga

SEQ ID NO: 184498 - RNA, 1701 nt, Artificial Sequence
  derived and/or modified sequence opt5 from hemagglutinin__InfluenzaA__ABL67286
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaauccggagacauccugcucaucaacagcacaggcaaucugauugcuccucgcggguauuucaagaucagaucuggaaagagcuccauuaugcggucugacgcccccaucggcaaauguaacagcgaaugcauuaccccuaauggcuccauccccaacgauaagccguuucagaaugugaaccgcaucaccuacgggccuugucccagauaugugaaacagaauacacuuaagcuggcuacgggaaugcggaacgucccugagaaacaaacccgcggcauuuucggggccaucgcgggauuuauugaaaauggcugggaggggaugauggacggaugguacggcuucagacaccagaacagcgagggcacagggcaggccgcugaucucaagucuacccaagccgcuaucaaucagauuaacggaaaacugaaucggcuuaucgaaaagacaaacgagaaguuucaucagaucgaaaaagaguucuccgaaguggagggccgcauucaggaccuggagaaguauguugaagauaccaaaaucgaccucuggagcuacaaugccgagcugcugguggcccucgaaaaccaacacacgauugaucugacagacucugagaugaacaaacuuuucgaaagaaccaagaagcagcugcgggagaaugcugaggauauggggaacggaugcuuuaagaucuaucauaaaugugacaaugcgugcauuggcuccaucagaaacgggaccuacgaucacgacgucuaccgcgacgaagcccucaauaaccgguuccagauuaagggcguggagcugaaaagcggauauaaggauuggauccuuuggaucuccuuugcuauuucuugcuuccugcucuguaucguucugcugggcuuuauuaugugggccugccagaaagggaauaucagauguaacauuugcaucuga

SEQ ID NO: 184499 - RNA, 1701 nt, Artificial Sequence; identical to SEQ ID NO: 184029
  derived and/or modified sequence opt5 from hemagglutinin__InfluenzaA__ABL67297

SEQ ID NO: 184500 - RNA, 1701 nt, Artificial Sequence
  derived and/or modified sequence opt5 from hemagglutinin__InfluenzaA__ABL67308
augaagaccaucauugcccugagcuacauccucugccugguguucgcucagaaacuucccggcaacgacaauuccauggccacacugugucucgggcaccaugcggucccuaacggaacgcugguuaagaccauuacaaaugaucaaaucgaggugaccaacgcuacagaacuugugcagucuagcuccaccggcagaauuugcgacucuccgcaccagauccuggauggggagaauuguacacucaucgacgcccugcugggagauccccauugcgacggcuuucagaacaaagaaugggaucucuucgucgagcggagcaaggccuauuccucuuguuacccuuaugacgugcccgauuacguuagccugcgcucccuuguggcuagcucugggacccuggaauuuaauaacgaguccuucaauuggacgggagucgcccaaaacggcaccagcucugcuugcaaaagacgguccgacaagagcuuuuucucucgccucaauuggcugcaccagcuuaaguauaaauacccugcccugaacgugacaaugcccaauaacgagaaguuugauaaacucuauauuuggggcguucaucacccugggaccgacuccgaucagaucagccuguacgcgcaggccuccggaagagugacagucucuaccaagcggagccaacagacggugauuccgaauaucggcucccgccccugggugagaggggucagcucucggauuuccaucuacuggacaauuguuaaaccuggagacauccugcucaucaacagcaccggcaaccugauugcuccccgcggguauuucaagaucagaucuggaaagagcuccauuaugcggucugacgccccuaucgauaaauguaauagcgaaugcauuacacccaacggcuccaucccgaaugacaagccuuuucagaacgugaaucgcaucaccuacggccuuugucccagauaugugaaacagaacacccugaagcucgcuacagggaugcggaaugucccugagaaacaaacgcgcggaauuuucggcgccaucgcgggguuuauugaaaacggaugggagggcaugauggaugggugguacggauucagacaccagaauagcgagggcaccggccaggccgcugaccugaagucuacacaagccgcuaucaaccagauuaaugggaaacuuaaccggcugaucgaaaagaccaaugagaaguuucaucagaucgaaaaagaguucuccgaaguggagggacgcauucaggaucucgagaaguauguugaagacacaaaaaucgaucuguggagcuacaacgccgagcugcucguggcccuggaaaaucaacacaccauugaccuuacggauucugagaugaacaagcuguucgaaagaaccaaaaagcagcuccgggagaacgcugaggacaugggcaaugggugcuuuaagaucuaucauaaaugugauaacgcgugcauuggauccaucagaaauggcacauacgaccacgacgucuaccgcgaugaagcccugaacaaucgguuccagauuaaggggguggagcuuaaaagcggcuauaaggacuggauccuguggaucuccuuugcuauuucuugcuuccuccuguguaucguucugcucggauuuauuaugugggccugccagaaaggcaacgugagauguaauaucugcauuuga

SEQ ID NO: 184501 - RNA, 1701 nt, Artificial Sequence; identical to SEQ ID NO: 183586
  derived and/or modified sequence opt5 from hemagglutinin__InfluenzaA__ABL67319

SEQ ID NO: 184502 - RNA, 1701 nt, Artificial Sequence; identical to SEQ ID NO: 184329
  derived and/or modified sequence opt5 from hemagglutinin__InfluenzaA__ABL67330

SEQ ID NO: 184503 - RNA, 1701 nt, Artificial Sequence; identical to SEQ ID NO: 183540
  derived and/or modified sequence opt5 from hemagglutinin__InfluenzaA__ABL67341

SEQ ID NO: 184504 - RNA, 1701 nt, Artificial Sequence; identical to SEQ ID NO: 183540
  derived and/or modified sequence opt5 from hemagglutinin__InfluenzaA__ABL67352

SEQ ID NO: 184505 - RNA, 1701 nt, Artificial Sequence; identical to SEQ ID NO: 183056
  derived and/or modified sequence opt5 from hemagglutinin__InfluenzaA__ABL67363

SEQ ID NO: 184506 - RNA, 1701 nt, Artificial Sequence
  derived and/or modified sequence opt5 from hemagglutinin__InfluenzaA__ABL67374
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagcccauuccaauuguuauccuuacgacgugcccgauuaugcuucucuccggagccugaucgccuccagcggaacgcuugaguuuaacaaugaaucuuucaacuggaccggcguuacacagaauggcaccuccagcgcuugcaagcgcagaucuaaccaguccuuuuucagccggcugaauuggcucacacaccugaaguuuaaauacccugcccuuaacgugaccaugcccaauaacgagaaguucgacaaacuguauauuuggggaguccaucacccugggacggauucugaccagaucucccucuacgcgcaagccccgggccgcauuacagugagcaccaagagaucccagcagacaguuauccccaacauugggucucggccucgcgugagagauaucagcucccggaucagcauuuauuggaccaucgucaaacccggagacauucugcugaucaauucuaccggcaaccucauugcuccucgcggguacuuuaagaugagauccggaaagagcucuaucaugaaaagcgacgcccccaucggcaaguguaauuccgagugcauuacaccgaacggcucuaucccuaaugauaaacccuuccagaacgugaaucggauuacguacggggcuuguccucgcuaugugaagcaaaacacccugaaacuugccacaggaaugagaaauguccccgaaaagcagacccggggcaucuuuggggcgauugccggauucaucgagaacggcugggaagggaugguugacggaugguacggcuuucgccaccagaauagcgagggcacagggcaagcugccgaucugaaauccacccaggcugccaucaaccagauuaauggaaagcucaacagacugaucggcaagacgaaugagaaauuccaucagauugaaaaggaguucagcgaaguggaggggcggauccaagaccuugaaaaauauguggaggauacaaagauugaccuguggucuuacaacgccgagcuccuggucgcucuggaaaaccagcacaccaucgaucucaccgacuccgagaugaauaaacuguuugaaagaacaaagaagcagcuucgcgagaacgcggaagauaugggagacggcugcuucaaaauuuaucauaagugugauaaugccugcaucgggagcauccggaacggcaccuacgaccacgacguguauagagaugaggcucugaauaaccgcuuucagauuaaaggaguugagcucaagucuggcuacaaagacuggauccuguggauuuccuucgccaucagcugccuucugcucuguguggcccugcugggguuuauuaugugggcuugccaaaagggaaauauccgguguaacaucugcauuuga

SEQ ID NO: 184507 - RNA, 1701 nt, Artificial Sequence; identical to SEQ ID NO: 183306
  derived and/or modified sequence opt5 from hemagglutinin__InfluenzaA__ABL67385

SEQ ID NO: 184508 - RNA, 1701 nt, Artificial Sequence; identical to SEQ ID NO: 183636
  derived and/or modified sequence opt5 from hemagglutinin__InfluenzaA__ABL67396

SEQ ID NO: 184509 - RNA, 1701 nt, Artificial Sequence; identical to SEQ ID NO: 183654
  derived and/or modified sequence opt5 from hemagglutinin__InfluenzaA__ABL67407

SEQ ID NO: 184510 - RNA, 1701 nt, Artificial Sequence
  derived and/or modified sequence opt5 from hemagglutinin__InfluenzaA__ABL67418
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaacuccuuuuucagccggcugaauuggcucacacaucugaaguuuaaauauccugcccuuaacgucaccaugcccaacaaugagaaguucgauaaacuguacaucuggggagugcaccauccugggacggacaacgaucagauuuuucucuaugcgcaggccucuggccgcaucacaguuuccaccaagagaagccaacagacagugauuccgaauaucgggucccggccccgcgucagaaacauuccuucucggaucagcaucuacuggaccauugugaaacccggagacauccugcugauuaauuccaccggcaaccucaucgcuccucgcggguacuucaagauuagaagcggaaagucuuccaucaugcggagcgaugcccccaucggcaaauguaauucugagugcauuacaccgaacggcagcaucccuaaugacaagcccuuucagaacgugaaucgcauuacguauggggcuuguccuagauacgucaaacagaacacccugaaacuugccacaggaaugcggaauguucccgaaaagcaaacccgcggcaucuucggggcgauugccggauuuaucgagaacggcugggaagggaugguggacggaugguauggcuucagacaccaaaauuccgagggcaucgggcaggcugccgaucugaagucuacacaggcugccauuaaccagaucaacggaaaacucaaucggcugauuggcaagaccaacgagaaguuccaccagaucgaaaaagaguuuagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguucgaaagaaccaaaaagcagcuucgggagaacgcggaagauaugggaaauggcugcuuuaagaucuaccacaaaugugacaacgccugcaucgggucuauuagaaauggcacauaugaucaugacguuuaccgcgaugaggcucugaacaaucgguuccagaucaagggaguggagcucaaauccggcuacaaggacuggauucuguggaucagcuuugccauuucuugcuuccuucugugugucgcccuccugggguuuaucaugugggcuugccagaaaggaaacaucagauguaauauuugcaucuga

SEQ ID NO: 184511 - RNA, 1707 nt, Artificial Sequence; identical to SEQ ID NO: 183052
  derived and/or modified sequence opt5 from hemagglutinin__InfluenzaA__ABL67781

SEQ ID NO: 184512 - RNA, 1707 nt, Artificial Sequence
  derived and/or modified sequence opt5 from hemagglutinin__InfluenzaA__ABL67794
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagaaacgcagaaagaaacggggacuguuuggcgcuauugccggcuucaucgaagggggauggcagggcaugguggacgggugguacggauaucaucacuccaacgagcaaggcucuggguacgcggccgacaaggaaagcacccagaaagcuauugauggaguuaccaauaaggugaacuccaucaucgacaagaugaauacacaguuugaggccgucggccgcgaguucaacaaccuugaaagacggauugagaaucugaacaaaaagauggaagauggcuuccucgacguguggacguauaaugcugagcugcugguucucauggaaaacgagcgcacccuggauuuucacgacucuaaugugaaaaaccuuuacgauaaggucagacugcaacuccgggacaaugccaaagaacuggggaacggauguuucgaguuuuaccauaagugcgauaaugaguguauggaaagcgugagaaacggcacauaugacuacccucaguauuccgaggaagcccgccuuaagcgggaggagaucagcggggucaaacuggaaucuauuggaaucuaccagauucucuccaucuauagcaccguggcuucuucccuggcgcuggccauuaugguugcuggccucagccuguggaugugcuccaaugggucucuucagugcagaaucuguaucuga

SEQ ID NO: 184513 - RNA, 1707 nt, Artificial Sequence
  derived and/or modified sequence opt5 from hemagglutinin__InfluenzaA__ABL67816
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaagccucccuuggcguuagcucugccuguccuuaccaggggaaauccagcuucuuucgcaacguggucuggcugaucaagaaaaauucuaccuaucccacaauuaagagauccuacaacaauaccaaccaagaggaccuccuggugcuuuggggaauccaccacccuaaugaugcugccgagcagacaaagcuguaucagaacccgaccacguacaucagcgugggcaccucuacacucaaccagcggcuggucccccgcauugcuaccagauccaaaguuaauggccaaagcgggcggauggaguucuuuuggacaauccugaagccuaacgacgccauuaauuucgaauccaacggaaauuuuaucgcgcccgaauacgccuauaaaauugugaagaaaggcgauucuaccaucaugaaaagcgagcucgaauacgggaacugcaauacgaaaugucagacaccuaugggagcuaucaacuccagcaugcccuuccauaauauucacccgcugaccaucggcgagugcccuaaguaugugaagucuaaccgccuuguccuggccacagggcucagaaauagcccccagcgggagcgcagacggaaaaagcgcggacuguuuggcgcuauugccggcuucaucgaagggggauggcagggcaugguggacgggugguacggauaucaucacuccaacgagcaaggcucuggguacgcggccgacaaagaaagcacccagaaggcuauugauggaguuaccaauaaagugaacuccaucaucaauaagaugaacacacaguuugaggccgucggcagagaguucaacaaucuugaacggcgcauugagaaccugaauaagaaaauggaagacggcuuccucgauguguggacguauaacgcugagcugcugguucucauggaaaaugagagaacccuggacuuucacgauucuaacgugaagaaucuuuacgacaaaguccggcugcaacucagagauaacgccaaggaacuggggaauggauguuucgaguuuuaccauaaaugcgacaacgaguguauggaaagcgugcgcaauggcacauaugauuacccucaguauuccgaggaagcccggcuuaagagagaggagaucagcggggucaagcuggaaucuauuggaaucuaccagauucucuccaucuauagcaccguggcuucuucccuggcgcuggccauuaugguugcuggccucagccuguggaugugcuccaacgggucucuucagugccgcaucuguaucuga

SEQ ID NO: 184514 - RNA, 1707 nt, Artificial Sequence
  derived and/or modified sequence opt5 from hemagglutinin__InfluenzaA__ABL67827
auggagaagaucgugcuccuguucgccauugucagccugguuaaauccgaccacaucugcauuggcuaccaugcuaacaauucuaccgaacagguggauacaaucauggagaagaacgugacggucacccacgcccaagacauucuugagaaaacacauaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaccuccugucucggaucaaucauuuugagaaaauucagaucauucccaagagcuccuggucuagccacgaagccucccuuggcguuagcucugccuguccuuaccaggggaaauccagcuucuuucgcaacguggucuggcugaucaagaaaaauucuaccuaucccacaauuaagagauccuacaacaauaccaaccaggaggaccuccuggugcuuuggggaauccaccauccuaaugaugcugccgagcaaacaaagcuguaucagaacccgaccacguacaucagcgugggcaccucuacacucaaccagcggcuggucccccgcauugcuaccagauccaaaguuaauggccagagcgggcggauggaguucuuuuggacaauccugaagccuaacgacgccauuaauuucgaauccaacggaaauuuuaucgcgcccgaauacgccuaugagauugugaaaaagggcgauucuaccaucaugaaaagcgaacucgaguacgggaacugcaauacgaagugucaaacaccuaugggagcuaucaacuccagcaugcccuuccacaauauucauccgcugaccaucggcgagugcccuaaauaugugaagucuaaccgccuuguccuggccacagggcucagaaauagcccccagauugaacggcgcagaaagaaacggggacuguuuggcgcuaucgccggcuuccuugaagggggauggcagggcaugguggacgggugguacggauaucaccacuccaacgaacagggcucuggguacgcggccgacaaggagagcacccaaaaagcuauugauggaguuaccaauaaggugaacuccaucaucaauaaaaugaacacacaguuugaagccgucggccgcgaguucaacaaucuggagagacggauugaaaaccucaauaagaagauggaggacggcuuccuggauguguggacguauaacgcugaacugcucguucugauggagaaugaacgcacccuugacuuucaugauucuaacgugaaaaaucuguacgacaaggucagacuccagcugcgggauaacgccaaagagcuugggaauggauguuucgaguuuuaccacaagugcgacaacgaauguauggagagcgugagaaauggcacauaugauuacccucaauauuccgaagaggcccgccugaaacgggaggaaaucagcggggucaagcucgagucuauuggaaucuaccagauucuguccaucuauagcaccguggcuucuucccuggcgcucgccauuaugguugcuggccugagccuuuggaugugcuccaacgggucucugcagugcagaaucuguaucuga

SEQ ID NO: 184515 - RNA, 1701 nt, Artificial Sequence
  derived and/or modified sequence opt5 from hemagglutinin__InfluenzaA__ABM22015
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccauuucuugcuuccuucugugugucgcccuccugggguuuaucaugugggcuugccagaaaggaaauaucagaugugauauuugcaucuga

SEQ ID NO: 184516 - RNA, 1701 nt, Artificial Sequence
  derived and/or modified sequence opt5 from hemagglutinin__InfluenzaA__ABM22026
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcaucgccggguggauucugggaaacccugagugcgaaucccucuuuucuaaagagagcugguccuacaucgccgaaaccccgaaucccaagaacggcacguguuauccuggguacuucgccgacuaugaggagcugcgggaacaacuuucuagcguguccagcuuuaagcgcuucgagauuuuucccaaagauucuuccuggccuaaucauaccguuacaaagggagugaccgcuagcugcucucacaacggcaaauccagcuucuacaagaaucugcucuggcugacagaaaagaacggccuuuaucccaaucugucuaaguccuacgucaacaagaaagggaaggaggugcucguucuguggggagugcaucacccuagcaauaugggcgaccagagagccaucuaccacaaagagaacgcguaugucuccgugcugucuagccauuacucccggcgcuuuaccccggaaaucgccagacggcccaaggugcgcgaucaggaggggagaauuaacuauuacuggacgcuccuggaaccuggagacacaaucauuuucgaggcuaauggcaaccuuaucgcccccugguaugcuuuugcccugagccggggguucggaucuggcauuaucauuuccaaugcgagcaugggcgaaugugaugccaaaugccagaccccucaaggggcuaucaacucuagccuccccuuucagaauguccacccgguuacaaucggagaguguccuaaguacgugcgcuccaccaaacugagaauggugaccggccuucggaacguccccucuauucagagccgcgggcuguucggagccaucgcuggcuuuauugaagggggauggacaggcaugaucgacggcugguauggguaccaucaccagaaugaacaaggauccggcuacgccgccgaucagaaaagcacgcagaacgcuauuaaugggaucaccaacaagguuaauucuaucauugagaaaaugaacacacaguucaccgcggugggaaaggaguucaauaaacucgagagacggauggaaaaccugaauaagaaaguggacgauggcuuucuggacaucuggacauauaacgccgagcuccugguccuucuggagaacgaacgcacccucgacuuccacgauuccaaugugaagaaccuguacgagaagguuaaaaaucaacuuaagaacaaugcuaaagaaauugggaacggcugcuuugaguucuaucauaaguguaauaacgaaugcauggagagcgugaaaaauggaacguacgacuauccuaaguacucuaaggaguccaaacugaacagagaaaagaucgauggcgucaaacucgagagcauggggguguaucagauucuggccaucuacuccacagucgccucuagccuggugcuccugguuucccuuggagcuaucucuuuuuggaugugcagcaauggcucccugcagugucggauuugcaucuga

SEQ ID NO: 184517 - RNA, 1701 nt, Artificial Sequence; identical to SEQ ID NO: 183657
  derived and/or modified sequence opt5 from hemagglutinin__InfluenzaA__ABM22037

SEQ ID NO: 184518 - RNA, 1701 nt, Artificial Sequence; identical to SEQ ID NO: 183075
  derived and/or modified sequence opt5 from hemagglutinin__InfluenzaA__ABM22059

SEQ ID NO: 184519 - RNA, 1701 nt, Artificial Sequence; identical to SEQ ID NO: 184329
  derived and/or modified sequence opt5 from hemagglutinin__InfluenzaA__ABM22070

SEQ ID NO: 184520 - RNA, 1701 nt, Artificial Sequence
  derived and/or modified sequence opt5 from hemagglutinin__InfluenzaA__ABM22081
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgaucaugcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaccugaaauacaaguauccugcccuuaaugucaccaugcccaacaaugagaaauuugauaagcuguacaucuggggagugcaucacccugggacggacucugaucagauuucccucuaugcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguacuucaagaucagaagcggaaaaucuagcauuaugcgguccgaugccccuaucggcaaguguaacucugagugcaucacacccaauggcagcauuccgaacgacaaaccuuuucagaaugucaaccgcaucacguauggggcuugucccagauacguuaagcagaauacccugaaacuugccacaggaaugcggaacauuccugaaaagcaaacccgcggcaucuucggggcgauugccggauuuaucgagaauggcugggaagggaugguggauggaugguauggcuucagacaccagaacuccgagggcacagggcaggcugccgaccugaaaagcacccaagcugccaucaaucagauuaacggaaagcucaaucggcugaucggcaagacgaacgagaaauuucaucagauugaaaaggaguucucugaaguggaggggagaauccaggaucuugaaaaauacgucgaggacacaaagauugaucugugguccuauaaugccgagcuccugguggcucuggaaaaccaacacaccaucgaccucaccgauagcgagaugaacaaacuguucgaacgcacaaagaagcagcuucgggagaaugcggaagacaugggaaacggcugcuuuaaaauuuaccauaagugugauaaugccugcaucgggucuaucagaaacggcaccuaugaccacgacguuuaccgcgaugaggcucugaauaaccgguuccagauuaaaggaguggagcucaaguccggcuacaaagacuggauccuguggauuagcuuugccaucuccugcuuccuucugugugucgcccuccugggguuuauuaugugggcuugccagaagggaaauaucagauguaacaucugcauuuga

SEQ ID NO: 184521 - RNA, 1701 nt, Artificial Sequence
  derived and/or modified sequence opt5 from hemagglutinin__InfluenzaA__ABM22092
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgaucaugcuucucuccggagccugguugccuccagcgggacgcuugaauuuaacaaugagucuuucgacugggcuggagugacccagaacggcacauccagcgccugcaagcgcagaucuaauaaguccuuuuucagccggcugaacuggcucacccaccugaaauacaaguauccugcgcuuaaugucacaaugcccaacaaugagaaauuugauaagcuguacaucuggggcgugcaucacccugggaccgacucugaucagauuucccucuaugcccaggcuagcggacgcaucacgguuuccacaaaaagaucucaacagaccgugauuccgaacaucggcagccggccccgcgucagagacguguccagccggauuucuaucuacuggacaaucgugaagccuggggacauucugcugaucaacuccaccggaaaucucauugcccccagaggcuacuucaagaucagaagcgggaaaucuagcauuaugcgguccgaugcuccuaucggaaaguguaacucugaaugcaucacccccaauggcagcauuccgaacgacaaaccuuuucagaaugucaaccgcaucacauauggcgccugucccagauacguuaagcagaauacgcugaaacuugcgaccgggaugcggaacgugccugagaagcaaacacgcggaauuuucggcgccaucgcuggguuuauugaaaauggaugggagggcaugguggaugggugguauggauucagacaccagaacuccgagggcaccggccaggccgcugaccugaaaagcacacaagccgccaucaaucagaucaacgggaagcucaaucggcugauuggaaagaccaacgaaaaauuucaucagaucgagaaggaguucucugaagucgaaggccgcauucaggaucuugagaaauacguggaggacacgaagaucgaucugugguccuauaaugcugaacuccugguugcgcuggagaaccaacacacaauugaccucaccgauagcgaaaugaacaaacuguucgagcgcaccaagaagcagcuucgggaaaaugccgaggacauggggaacggaugcuuuaaaaucuaccauaagugugauaaugcuugcauuggcucuaucagaaacgggacauaugaccacgacguguaccgcgaugaggcccugaauaaccgguuccagaucaaaggcgucgaacucaaguccggauacaaagacuggauucuguggaucagcuuugccauuuccugcuuccuucuguguguggcucuccugggcuuuaucaugugggccugccagaaggggaauauuagauguaacaucugcaucuga

SEQ ID NO: 184522 - RNA, 1701 nt, Artificial Sequence; identical to SEQ ID NO: 184334
  derived and/or modified sequence opt5 from hemagglutinin__InfluenzaA__ABM22103

SEQ ID NO: 184523 - RNA, 1701 nt, Artificial Sequence; identical to SEQ ID NO: 183540
  derived and/or modified sequence opt5 from hemagglutinin__InfluenzaA__ABM22114

SEQ ID NO: 184524 - RNA, 1701 nt, Artificial Sequence; identical to SEQ ID NO: 184479
  derived and/or modified sequence opt5 from hemagglutinin__InfluenzaA__ABM22125

SEQ ID NO: 184525 - RNA, 1701 nt, Artificial Sequence
  derived and/or modified sequence opt5 from hemagglutinin__InfluenzaA__ABM22136
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccaucggaaugcggaacguucccgaaaagcaaacacgcggcauuuucggggcgaucgccggauuuaucgagaauggcugggaagggaugguggauggaugguauggcuucagacaccagaacuccgagggcauugggcaggcugccgaccugaagucuacccaagcugccaucaaucagauuaacggaaaacucaaccggcugaucggcaagacaaaugagaaguuccaccagauugaaaaagaguuuagcgaaguggaggggagaauccaggaucuugaaaaguacgucgaggacaccaaaauugaucugugguccuauaacgccgagcuccugguggcucuggaaaaucaacauacgaucgaccucacagauagcgagaugaacaagcuguucgaacgcaccaaaaagcagcuucgggagaaugcggaagacaugggaaacggcugcuuuaagaucuaccacaaaugugauaaugccugcauugggucuaucagaaacggcaccuaugaccaugauguuuaccgcgacgaggcucugaauaaccgguuccagauuaagggaguggagcucaaauccggcuacaaggacuggauccuguggauuagcuuugccaucucuugcuuccuucugugugucgcccuccugggguuuaucaugugggcuugccagaaaggaaauauuagauguaacaucugcauuuga

SEQ ID NO: 184526 - RNA, 1701 nt, Artificial Sequence; identical to SEQ ID NO: 183657
  derived and/or modified sequence opt5 from hemagglutinin__InfluenzaA__ABM22147

SEQ ID NO: 184527 - RNA, 1701 nt, Artificial Sequence; identical to SEQ ID NO: 183945
  derived and/or modified sequence opt5 from hemagglutinin__InfluenzaA__ABM22158

SEQ ID NO: 184528 - RNA, 1701 nt, Artificial Sequence; identical to SEQ ID NO: 183945
  derived and/or modified sequence opt5 from hemagglutinin__InfluenzaA__ABM22169

SEQ ID NO: 184529 - RNA, 1701 nt, Artificial Sequence; identical to SEQ ID NO: 183945
  derived and/or modified sequence opt5 from hemagglutinin__InfluenzaA__ABM22180

SEQ ID NO: 184530 - RNA, 1701 nt, Artificial Sequence; identical to SEQ ID NO: 183945
  derived and/or modified sequence opt5 from hemagglutinin__InfluenzaA__ABM22191

SEQ ID NO: 184531 - RNA, 1701 nt, Artificial Sequence; identical to SEQ ID NO: 183945
  derived and/or modified sequence opt5 from hemagglutinin__InfluenzaA__ABM22202

SEQ ID NO: 184532 - RNA, 1701 nt, Artificial Sequence; identical to SEQ ID NO: 183945
  derived and/or modified sequence opt5 from hemagglutinin__InfluenzaA__ABM22213

SEQ ID NO: 184533 - RNA, 1701 nt, Artificial Sequence; identical to SEQ ID NO: 183945
  derived and/or modified sequence opt5 from hemagglutinin__InfluenzaA__ABM22224

SEQ ID NO: 184534 - RNA, 1701 nt, Artificial Sequence; identical to SEQ ID NO: 183945
  derived and/or modified sequence opt5 from hemagglutinin__InfluenzaA__ABM22235

SEQ ID NO: 184535 - RNA, 1701 nt, Artificial Sequence
  derived and/or modified sequence opt5 from hemagglutinin__InfluenzaA__ABM22268
augaaggugaaacugcucguccugcuuugcgccuucaccgcuacauacgccgacacgaucuguauuggcuaucacgcgaacaauagcaccgauacaguugacaccgugcuggagaagaacgugacagucacccauuccgugaaucuccuggaagauucucacaacgggaaacuuugcagacugaagggaacagcuccccuccagcugggcaauuguagcguugccggguggauccugggaaacccugagugcgaaucccucuuuucuaaagagagcugguccuacauugccgaaaccccgaaucccgagaacggcacguguuauccuggguacuucgcugacuaugaggaacugcgggagcaacuuucuagcguguccagcuuugaacgcuucgagaucuuucccaaggagucuuccuggccuaaucauaccgucacaaagggagugaccgccagcugcucucacaacggcaaauccagcuucuacaagaaucugcucuggcugacagaaaagaacggccuuuaucccaaucugucuaaguccuacguuaacaauaaagagaaggaagugcucguccuguggggagugcaucacccuagcaacauuggggaucagagagcuaucuaccacaccgagaacgccuauguguccgucguuucuagccauuacucccggcgcuuuacgccggaaaucgcgaagagacccaaagugcgggaccaggagggccgcauuaauuauuacuggacacugcucgagccuggggauaccaucauuuucgaagccaacggaaaucugaucgcucccugguaugccuuugcucuuagcagaggcuucgggucuggaauuaucacauccaacgccagcaugggcgagugugacgcgaagugccagaccccucaaggcgccauuaauucuagccugcccuuucagaacgugcacccggucaccaucggggaauguccuaaauacgugcgguccacaaagcuccgcaugguuacgggacugagaaauauccccucuauucagagccggggccuuuucggggcuaucgccggauuuauugagggcggguggaccggaaugaucgauggcugguauggcuaccaucaccagaacgaacaaggguccggauacgcugccgaccagaaaagcacacagaaugccauugauggcaucaccaacaaggucaauucugugaucgagaaaaugaacacacaguucaccgcuguggggaaggaguucaauaagcuggaacgcagaauggagaaccucaauaaaaagguugacgauggauuucuggacauuuggacguauaacgcggaacugcucgugcugcuugagaacgaacggacacuggacuuccacgauuccaaugucaaaaaccucuacgagaaggugaaaaaucaacugaagaacaaugccaaggagaucggcaacgggugcuuugaguucuaucauaaauguaauaacgaaugcauggaaagcgucaagaauggcaccuacgacuauccuaaauacucugaggaguccaaacuuaaccgcgagaaaauugauggagugaagcuggaaagcaugggcguuuaucagauccucgcuauuuacuccaccguggccucuagccugguccugcucgugucccugggggccaucucuuuuuggaugugcagcaauggaucccuucaguguagaaucugcauuuga

SEQ ID NO: 184536 - RNA, 1701 nt, Artificial Sequence
  derived and/or modified sequence opt5 from hemagglutinin__InfluenzaA__ABM22279
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauagacacaacgggaaacuuugccggcugaagggaacagcuccccuccagcugggcaauuguucuguggccggguggauccugggaaacccugagugcgaaagccucuuuuccaaagagucuuggagcuacauugccgaaaccccgaaucccgagaacggcacguguuauccuggguacuucgccgacuaugaggaacugcgcgagcaacuuuccucuguuagcuccuuugaaagauucgagaucuuucccaaggagagcucuuggccuaaucauaccgugacaaagggagucaccgcuuccugcagccacaacggcaaaucuuccuucuacaagaaucugcucuggcugacagagaaaaacggccuuuaucccaaucugagcaagucuuacgugaacaauaaagagaaggaaguucucgugcuguggggaguccaucacccuuccaacauuggggaucagcgggccaucuaccacaccgagaacgcguaugugagcguggucuccucucauuacagccgcagauuuacgccggaaaucgccaagcggcccaaaguucgcgaccaggagggcagaauuaauuauuacuggacacugcucgagccuggggauaccaucauuuucgaagcuaacggaaaucugaucgcccccugguaugcuuuugcccuuucccggggcuucgggagcggaauuaucacaucuaacgcguccaugggcgacugugaugccaagugccagaccccucaaggcgcuauuaauagcucucugcccuuucagaacgugcacccggugaccaucgggggauguccuaaauacguccgcagcacaaagcucagaauggugacgggccugcggaauauccccuccauucagucucgcgggcuuuucggagccaucgcuggcuuuauugaagggggauggaccggcaugaucgacggcugguauggguaccaucaccagaacgaacaaggaagcggcuacgccgccgauaaaaaguccacacagaaugcuauugacgggaucaccaacaaaguuaauagcgugaucgagaagaugaacacacaguucaccgcggucggaaaggaguucaauaaacuggaaagacggauggagaaccucaauaagaaaguggaugacggcuuucuggacauuuggacguauaacgccgaacugcucguucugcuugagaacgaacgcacacuggauuaccacgacucuaaugugaagaaccucuaugagaaagucaagaaucagcugaagaacaaugcuaaagaaaucgggaacggcugcuucgaguuuuaccauaaguguaauaacgagugcauggaauccgugaaaaauggaaccuaugauuacccuaaguauagcgaggaaucuaaacuuaagagagagaagauugacggcgucaaacuggaguccauggggguguaccaaauccucgccauuuacagcaccguugccuccucucuggugcugcucgucagccugggagcuaucuccuucuggaugugcucuaacggcagccuucagugucggaucugcauuuga

SEQ ID NO: 184537 - RNA, 1701 nt, Artificial Sequence
  derived and/or modified sequence opt5 from hemagglutinin__InfluenzaA__ABM22290
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaaaacucucacaaugggaaacuuugcagacugaagggaacagcuccccuccagcugggcaacuguagcguggccggguggauccugggaaauccugagugcgaaucccucuuuucuaaagagagcugguccuacauugccgaaaccccgaaccccgagaauggcacguguuauccuggguacuucgccgauuaugaggaacugcgggagcaacuuucuagcguuuccagcuuugaacgcuucgagaucuuucccaaggagucuuccuggccuaaccauaccgugacaaagggagucaccgcuagcugcucucacaauggcaaauccagcuucuacaagaaccugcucuggcugacagaaaagaauggccuuuaucccaaccugucuaaguccuacgugaauaacaaagagaaggaaguucucgugcuguggggaguccaucacccuagcaacauuggggaccagagagccaucuaccacaccgagaaugcguauguguccguggucucuagccauuacucccggcgcuuuacgccggaaaucgccaagagacccaaaguucgggaucaggagggccgcauuaacuauuacuggacacugcucgagccuggggacaccaucauuuucgaagcuaauggaaaccugaucgcccccugguaugcuuuugcccuuagcagaggcuucgggucuggaauuaucacauccaaugcgagcaugggcgagugugaugccaagugccagaccccucaaggcgcuauuaacucuagccugcccuuucagaaugugcacccggugaccaucggggaauguccuaaauacguccgguccacaaagcuccgcauggugacgggacugagaaacauccccucuauucagagccggggccuuuucggggccaucgcuggauuuauugagggcggguggaccggaaugaucgacggcugguauggcuaccaucaccagaaugaacaaggguccggauacgccgccgaucagaaaagcacacagaacgcuauugacggcaucaccaauaagguuaacucugugaucgagaaaaugaauacacaguucaccgcggucgggaaggaguucaacaagcuggaacgcagaauggagaaucucaacaaaaagguggaugacggauuucuggauauuuggacguauaacgccgaacugcucguucugcuugagaaugaacggacacuggacuuccacgacuccaacgugaaaaaucucuacgagaaggucaaaaaccaacugaagaauaacgcuaaggagaucggcaaugggugcuuugaguucuaucauaaauguaacaaugaaugcauggaaagcgugaagaacggcaccuacgauuauccuaaauacucugaggaguccaaacuuaaucgcgagaaaauugacggagucaagcuggaaagcaugggcguguaucagauccucgccauuuacuccaccguugccucuagccuggugcugcucgucucccugggggcuaucucuuuuuggaugugcagcaacggaucccuucaguguagaaucugcauuuga

SEQ ID NO: 184538 - RNA, 1701 nt, Artificial Sequence; identical to SEQ ID NO: 183279
  derived and/or modified sequence opt5 from hemagglutinin__InfluenzaA__ABM22301

SEQ ID NO: 184539 - RNA, 1701 nt, Artificial Sequence; identical to SEQ ID NO: 183279
  derived and/or modified sequence opt5 from hemagglutinin__InfluenzaA__ABM22312

SEQ ID NO: 184540 - RNA, 1701 nt, Artificial Sequence; identical to SEQ ID NO: 183279
  derived and/or modified sequence opt5 from hemagglutinin__InfluenzaA__ABM22323

SEQ ID NO: 184541 - RNA, 1701 nt, Artificial Sequence; identical to SEQ ID NO: 183279
  derived and/or modified sequence opt5 from hemagglutinin__InfluenzaA__ABM22334

SEQ ID NO: 184542 - RNA, 1701 nt, Artificial Sequence; identical to SEQ ID NO: 183280
  derived and/or modified sequence opt5 from hemagglutinin__InfluenzaA__ABM22345

SEQ ID NO: 184543 - RNA, 1701 nt, Artificial Sequence; identical to SEQ ID NO: 183280
  derived and/or modified sequence opt5 from hemagglutinin__InfluenzaA__ABM22356

SEQ ID NO: 184544 - RNA, 1701 nt, Artificial Sequence; identical to SEQ ID NO: 183280
  derived and/or modified sequence opt5 from hemagglutinin__InfluenzaA__ABM22367

SEQ ID NO: 184545 - RNA, 1698 nt, Artificial Sequence; identical to SEQ ID NO: 183865
  derived and/or modified sequence opt5 from hemagglutinin__InfluenzaA__ABM66864

SEQ ID NO: 184546 - RNA, 1701 nt, Artificial Sequence; identical to SEQ ID NO: 183945
  derived and/or modified sequence opt5 from hemagglutinin__InfluenzaA__ABM66886

SEQ ID NO: 184547 - RNA, 1701 nt, Artificial Sequence; identical to SEQ ID NO: 183945
  derived and/or modified sequence opt5 from hemagglutinin__InfluenzaA__ABM66897

SEQ ID NO: 184548 - RNA, 1701 nt, Artificial Sequence; identical to SEQ ID NO: 183945
  derived and/or modified sequence opt5 from hemagglutinin__InfluenzaA__ABM66908

SEQ ID NO: 184549 - RNA, 1701 nt, Artificial Sequence; identical to SEQ ID NO: 183280
  derived and/or modified sequence opt5 from hemagglutinin__InfluenzaA__ABM66919

SEQ ID NO: 184550 - RNA, 1701 nt, Artificial Sequence; identical to SEQ ID NO: 183280
  derived and/or modified sequence opt5 from hemagglutinin__InfluenzaA__ABM66930

SEQ ID NO: 184551 - RNA, 1701 nt, Artificial Sequence; identical to SEQ ID NO: 183280
  derived and/or modified sequence opt5 from hemagglutinin__InfluenzaA__ABM66941

SEQ ID NO: 184552 - RNA, 1701 nt, Artificial Sequence; identical to SEQ ID NO: 183280
  derived and/or modified sequence opt5 from hemagglutinin__InfluenzaA__ABM66952

SEQ ID NO: 184553 - RNA, 1701 nt, Artificial Sequence; identical to SEQ ID NO: 183280
  derived and/or modified sequence opt5 from hemagglutinin__InfluenzaA__ABM66963

SEQ ID NO: 184554 - RNA, 1701 nt, Artificial Sequence; identical to SEQ ID NO: 183280
  derived and/or modified sequence opt5 from hemagglutinin__InfluenzaA__ABM66974

SEQ ID NO: 184555 - RNA, 1701 nt, Artificial Sequence; identical to SEQ ID NO: 183280
  derived and/or modified sequence opt5 from hemagglutinin__InfluenzaA__ABM66985

SEQ ID NO: 184556 - RNA, 1701 nt, Artificial Sequence; identical to SEQ ID NO: 183280
  derived and/or modified sequence opt5 from hemagglutinin__InfluenzaA__ABM66996

SEQ ID NO: 184557 - RNA, 1701 nt, Artificial Sequence; identical to SEQ ID NO: 183280
  derived and/or modified sequence opt5 from hemagglutinin__InfluenzaA__ABM67007

SEQ ID NO: 184558 - RNA, 1701 nt, Artificial Sequence; identical to SEQ ID NO: 183280
  derived and/or modified sequence opt5 from hemagglutinin__InfluenzaA__ABM67018

SEQ ID NO: 184559 - RNA, 1701 nt, Artificial Sequence
  derived and/or modified sequence opt5 from hemagglutinin__InfluenzaA__ABM67029
augaagaccaucauugcccugagcuacaucauuugccucguguucgcucagaaacugcccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggcgugcaccauccugggacggauaaugaccagaucuuucuguaugcgcaggccucuggacgcauuacaguuuccaccaagagaagccaacagacagugaucccgaacauuggcucccggccccgcgucagagauaucccuucucggaucagcauuuacuggaccaucgugaaacccggggacauucuccugaucaauuccaccggaaaccugauugcuccucgcggcuacuucagaauccggagcgggaagucuuccaucaugcgcagcgacgcccccauuggaaaguguaauucugaaugcaucacaccgaacggcagcauuccuaaugauaaacccuuucagaacgugaauagaaucacguauggcgcuuguccucgguacgucaagcagaacacccucaaacuggccacagggaugcgcaauguucccgagaagcaaaccagaggaauuuucggcgcgaucgccggguuuaucgaaaacggaugggagggcaugguggacgggugguauggauuccggcaccaaaauuccgagggcauuggccaggcugccgaucuuaaaucuacacaggcugccaucaaccagauuaaugggaagcugaacagacucaucggaaaaaccaacgaaaaguuccaccagauugagaaggaauuuagcgagguggaaggccgcauccaggaccuggagaaauacgucgaggauacgaagauugaccuuugguccuauaaugccgaacugcucguggcucuggagaaccaacauacaaucgaucugaccgacagcgaaaugaauaaacucuucgagcggaccaagaaacagcugagagaaaacgcggaggauauggggaauggaugcuuuaagaucuaccacaagugugacaacgccugcauuggcucuauccgcaaugggacauaugaucaugacguuuaccgggacgaggcucuuaacaauagauuccagauuaaaggcguggaacugaaguccggauacaaagauuggauccucuggauuagcuuugccaucucuugcuuccugcuuugugucgcccugcucggcuuuaucaugugggcuugccagaaggggaacauucgcuguaauaucugcauuuga

SEQ ID NO: 184560 - RNA, 1698 nt, Artificial Sequence; identical to SEQ ID NO: 183323
  derived and/or modified sequence opt5 from hemagglutinin__InfluenzaA__ABM67051

SEQ ID NO: 184561 - RNA, 1707 nt, Artificial Sequence
  derived and/or modified sequence opt5 from hemagglutinin__InfluenzaA__ABM90467
auggagaagaucgugcugcuccugagcauugucucccuuguuaaaucugaccagaucugcauuggcuaccacgccaacaauagcaccgaacaaguggauacaaucauggagaagaacgugacggucacccaugcucaggacauucuggaaaagacacacaaugggaagcucugugaucuggacggagugaaaccccuuauccugagagauugcuccguugccggcuggcuccuggggaacccuaugugugacgaguucaucaaugugccggaauggucuuauauugucgagaaggcgaaccccaccaaugaucugugcuacccugggagcuuuaacgacuaugaggaacucaagcaucugcuuucccggaucaaucacuucgagaaaauucagaucauucccaagucuagcugguccgaucaugaagcuagcucuggcguguccagcgccuguccuuaccuggggucucccuccuuuuuccgcaacguuguguggcucaucaaaaagaauagcacauauccuaccauuaaaaagucuuacaacaauacaaaccaggaggaccugcuuguccuguggggaauccaccacccgaauaacgaggccgaacaaaccagacucuaucagaaccccacgaccuacaucuccauuggcacaagcacccugaaucagcggcuggugccuaagaucgcuacacgcuccaaagugaacggccagucugggagaauggaguuuuucuggaccauucucaagcccaaugaugccaucaacuuugaaagcaauggaaacuucauugcuccugaguacgccuauaaaaucgucaagaaaggcgacuccgcgaucaugaaaagcgaacuggaguacgggaauugcaacacgaaaugucaaacacccaugggagccauuaauucuuccaugccguuucauaacauccacccucuuaccauuggcgagugccccaaguauguuaagagcaaucggcuggugcucgcuacagggcugcgcaacucuccucagagagaaagccggcgcaaaaagagaggacuuuucggcgccaucgcuggcuuuauugagggaggauggcagggcaugguggaugggugguacggauaucaucacuccaaugaacagggcucuggguacgccgcggacaaagagagcacccaaaaggccaucgacggagucaccaacaaaguuaauuccaucauugauaagaugaacacacaguucgaagcugugggccgggaguuuaacaaucuggagcgcagaaucgaaaaccucaauaagaaaauggaggacggcuuccuggauguguggacguauaacgccgaacugcucguccugauggagaaugaacggacccuugacuuccacgauagcaacgugaagaaucuguacgacaaaguucgccuccagcugagagauaacgcuaaggagcuugggaauggauguuuugaguucuaccauaaaugcgacaacgaauguauggagucuauucggaauggcacauauaacuacccccaauauuccgaagaggccagacugaagcgcgaggaaaucagcggggugaagcucgagucuauuggaaccuaccagauccuguccauuuauagcacagucgccuccucucuggcucucgcgaucaugaucgccggccugagccuuuggaugugcuccaaugggucucugcagugccggauuuguaucuga

SEQ ID NO: 184562 - RNA, 1707 nt, Artificial Sequence
  derived and/or modified sequence opt5 from hemagglutinin__InfluenzaA__ABM90511
auggagaagaucgugcugcuccugagcauugucucccuuguuaaaucugaccagaucugcauuggcuaccacgccaacaauagcaccgaacaaguggauacaaucauugagaagaacgugacggucacccaugcucaggacauccuggagaaaacacacaaugggaagcucugugaucuggacggagugaaaccccuuauccugaaggauugcuccguugccggcuggcuccuggggaacccuaugugugacgaguucauuaaugugccggaauggucuuauaucgucgagaaggcgaaccccaccaaugaucugugcuacccuggauccuuuaacgacuaugaggaacucaaacaucugcuuuccagaauuaaucacuucgagaagauccagauuauccccaaaucuagcugguccgaucaugaagcuagcucuggcguguccagcgccuguccuuaccuggggucucccuccuuuuuccggaacguuguguggcucauuaagaaaaauagcacauauccuaccaucaagaagucuuacaacaauacaaaccaggaggaccugcuuguccuguggggaauccaccacccgaauaacgaggaagaacaaacccgccucuaucagaaccccacgaccuacauuuccaucggcacaagcacccugaaucagagacuggugccuaaaauugccacacgguccaaggugaacggccagucugggcgcauggaauuuuucuggaccauccucaaacccaaugaugcuauuaacuuugagagcaauggaaacuucaucgccccugaauacgcuuauaagaucgucaaaaagggcgacuccgccauuaugaaaagcgagcuggaguacucuaauugcaacacgaagugucaaacacccaugggggcgaucaauuccagcaugccguuucauaacauucacccucuuaccaucggagaaugccccaaguauguuaaaucuagcagacuggugcucgccacaggccugcggaauagcccucagcgcgagucuagacggaagaaacgcgggcuuuucggagcuauugccggcuuuaucgaaggcggguggcagggaaugguggauggcugguacggguaucaucacagcaacgagcagggauccggcuacgcugccgacaaggaaagcacccaaaaagcgaucgacggggucaccaauaaggugaacucuauuaucgauaagaugaauacacaguucgaggccguuggaagagaguuuaacaaccuggaacggcgcauugagaaucucaacaaaaagauggaagacggcuuccuggauguguggacguauaaugcugagcugcucguccugauggaaaacgagagaacccuugacuuccacgauuccaaugugaaaaaccuguacgacaagguucggcuccagcugcgcgauaaugccaaagagcuuggcaacggguguuuugaguucuaccauaagugcgacaaugaauguauggaaagcaucagaaacggaacauauaauuacccccaauauucugaggaggcucggcugaagagagaagagauuuccggcgugaaacucgaaagcaucgggaccuaccagauucuguccaucuauucuacagucgccagcucccuggcccucgcuaucaugauugcgggacugucucuuuggaugugcagcaacggcucccugcagugccgcaucuguauuuga

SEQ ID NO: 184563 - RNA, 1707 nt, Artificial Sequence
  derived and/or modified sequence opt5 from hemagglutinin__InfluenzaA__ABM90533
auggagaagaucgugcugcuccugagcauugucucccuuguuaaaucugaccagaucugcauuggcuaccacgccaacaauagcaccgaacaaguggauacaaucauggagaagaacgugacggucacccaugcucaggacauucuggagaaaacacacaaugggaagcucugugaucuggacggagugaaaccccuuauccugaaggauugcuccguugccggcuggcuccuggggaacccuaugugugacgaguucaucaaugugccggaauggucuuauauugucgagaaggcgaaccccaccaaugaucugugcuacccuggauccuuuaacgacuaugaggaacucaaacaucugcuuuccagaaucaaucacuucgagaagauucagaucauucccaaaucuagcugguccgaucaugaagcuagcucuggcguguccagcgccuguccuuaccuggggucucccuccuuuuuccggaacguuguguggcucaucaagaaaaauagcacauauccuaccauuaagaagucuuacaacaauacaaaccaggaggaccugcuuguccuguggggaauccaccacccgaauaacgaggaagaacaaacccgccucuaucagaaccccacgaccuacaucuccauuggcacaagcacccugaaucagagacuggugccuaaaaucgccacacgguccaaggugaacggccagucugggcgcauggaauuuuucuggaccauucucaaacccaaugaugcuaucaacuuugagagcaauggaaacuucauugccccugaauacgcuuauaagaucgucaaaaagggcgacuccgccaucaugaaaagcgagcuggaguacucuaauugcaacacgaagugucaaacacccaugggggcgauuaauuccagcaugccguuucauaacauccacccucuuaccauuggagaaugccccaaguauguuaaaucuagcagacuggugcucgccacaggccugcggaauagcccucagcgcgagucuagacggaagaaacgcgggcuuuucggagcuaucgccggcuuuauugaaggcggguggcagggaaugguggauggcugguacggguaucaucacagcaacgagcagggauccggcuacgcugccgacaaggaaagcacccaaaaagcgaucgacggggucaccaauaaggugaacucuaucauugauaagaugaauacacaguucgaggccguuggaagagaguuuaacaaccuggaacggcgcaucgagaaucucaacaaaaagauggaagacggcuuccuggauguguggacguauaaugcugagcugcucguccugauggaaaacgagagaacccuugacuuccacgauuccaaugugaaaaaccuguacgacaagguucggcuccagcugcgcgauaaugccaaagagcuuggcaacggguguuuugaguucuaccauaagugcgacaaugaauguauggaaagcauuagaaacggaacauauaauuacccccaauauucugaggaggcucggcugaagagagaagagaucuccggcgugaaacucgaaagcauugggaccuaccagauccuguccauuuauucuacagucgccagcucccuggcccucgcuaucaugaucgcgggacugucucuuuggaugugcagcaacggcucccugcagugccgcauuuguaucuga

SEQ ID NO: 184564 - RNA, 1707 nt, Artificial Sequence; identical to SEQ ID NO: 184563
  derived and/or modified sequence opt5 from hemagglutinin__InfluenzaA__ABM90544

SEQ ID NO: 184565 - RNA, 1701 nt, Artificial Sequence
  derived and/or modified sequence opt5 from hemagglutinin__InfluenzaA__ABN50900
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaagucuuccuuuuaucggaaucuccuguggcuuaccgagaaaaacggcagcuacccuaaucuguccaagucuuaugucaacaauaaggaaaaagaggugcucguucuguggggagugcaucaccccagcaacaucgaagaccagaagacaauuuaccgcaaagagaaugccuacgucuccguggugagcucucacuauaacagacgguucaccccugaaaucgcgaagcgcccgaaagucagagggcaggagggccggauuaacuacuauuggacacugcucgagcccggggauaccaucauuuuugaagccaauggaaaccugaucgcuccuugguacgccuucgcucuuucccgcggcuuugggagcggaauuaucacgucuaaugccagcauggacgagugugaugcgaagugccagacaccccaaggcgccaucaacuccucucugccuuuccagaauguucaucccgugaccauuggcgaauguccgaaauaugugagaagcacaaagcuccggauggucaccgggcugcgcaacaucccuuccauucagagcagaggacuuuuuggcgcuaucgccggguucauugagggaggcuggaccgggaugaucgacggaugguacggcuaucaccaucagaaugaacaaggcucuggguacgcugccgaucagaaguccacacagaacgccaucaauggaauuacgaacaaagugaauagcguuaucgagaagaugaacacccaguuuacagcugugggcaaagaguucaauaagcuggaaaaacggauggagaaccucaauaagaaggucgacgauggguuccuggacauuuggaccuacaacgcggaacugcucgugcugcuugagaacgaacgcacacuggacuuucacgauucuaauguuaaaaaccucuaugagaaggugaaaucccaacugaagaauaacgccaaagagaucggaaauggcugcuucgaauuuuaccacaaguguaacaaugagugcauggaaagcgucaagaacgggaccuaugacuaccccaaauauuccgaggagucuaaacuuaauagagaaaagauugauggcgugaagcuggagagcaugggagucuaccagauccucgcuaucuauuccacgguggccucuagccugguucugcucgugucccugggcgccauuagcuucuggaugugcucuaacgggucccuucagugucggaucugcauuuga

SEQ ID NO: 184566 - RNA, 1701 nt, Artificial Sequence; identical to SEQ ID NO: 183945
  derived and/or modified sequence opt5 from hemagglutinin__InfluenzaA__ABN50917

SEQ ID NO: 184567 - RNA, 1701 nt, Artificial Sequence
  derived and/or modified sequence opt5 from hemagglutinin__InfluenzaA__ABN50928
augaaggccaagcugcucauccugcuuugcgcuuucaccgccacagacgcggauacgauuuguaucggcuaccacgcuaacaauagcaccgacacaguggauaccguccuggagaagaacguuacagugacccauuccgugaaucuccuggaagacucucacaacgggaaacuuugcagacugaagggaauugccccgcuccagcugggcaauuguagcaucgccggguggauucugggaaacccugagugcgaaucccucuuuucuaaaaagagcugguccuauaucgcugagacacccaauucugaaaacggcaccuguuaccccggguauuucgccgauuacgaggagcugcgggaacaacuuagcuccgucagcucuuuugagcgcuucgaaaucuuuccuaaggaguccagcuggcccaaucauacggugaccaaaggaguuacagcuucuugcucccacaagggcaaaagcucuuucuauagaaaccugcucuggcugaccgagaagaauggcuccuacccuaaccuuagcaaauccuaugugaauaacaaggaaaaggagguccuggugcucuggggaguucaucaccccucuaauauuggggaccagcgggccaucuaccacacagaaaacgcguacgugagcgucguguccagccauuauaaccgcagauuuaccccugagauugccaaacggccgaaggugcgcggccaggaagggagaaucaauuacuauuggacgcugcuggagcccggagauacaauuaucuucgaggcuaacggcaaucucauugccccuugguacgcuuuugcccugucucggggguucggauccggcaucaucaccagcaacgcgucuauggacgaaugugaugccaaaugccagacaccccaaggcgcuauuaauagcucccuuccuuuucagaacguccaccccguuaccaucggggaguguccgaaguaugugcgcucuaccaaacugagaauggugacaggacuccggaauauuccuagcauccagucccgcggccuguucggggccauugcuggauuuaucgaaggcggguggacgggaaugaucgacggcugguacggcuaucaucaccagaacgagcaagggagcggauacgccgccgaucagaagucuacccagaaugcuauuaacggcaucacaaauaaagucaacuccgugauugaaaagaugaauacccaguucacagcgguugggaaggaguucaacaaacuugagagacggauggaaaaucugaacaagaaaguggacgauggauuucucgacaucuggaccuacaacgccgagcugcugguccuccuggaaaaugagcgcacgcuugacuuccacgauagcaacgugaagaaucuguaugaaaaaguuaagucucaacucaagaacaaugcuaaagagauuggcaacgggugcuuugaguucuaccauaaguguaauaacgaaugcauggaguccgugaaaaauggcacauaugacuaccccaaguauagcgaagaguccaaacugaacagagagaagaucgauggagucaaacuugaaucuaugggcguguaccagauccuggccauuuauagcaccgucgccuccucucucgugcugcugguuagccucggggcuaucuccuuuuggaugugcagcaauggaucucugcagugucggauuugcaucuga

SEQ ID NO: 184568 - RNA, 1701 nt, Artificial Sequence
  derived and/or modified sequence opt5 from hemagglutinin__InfluenzaA__ABN50940
augaaggccaagcugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucagcgauuacgaggagcugcgggaacaacuuuccagcgugucuuccuuugagcgcuucgaaaucuuuccuaaggagagcucuuggcccaaucauacgguuaccaaaggagugacagccuccugcagccacaagggcaaaucuuccuucuauagaaaccugcucuggcugaccgagaagaauggcagcuacccuaaccuuuccaaaucuuaugucaauaacaaggaaaaggaggugcugguucucuggggagugcaucaccccagcaauaucggggaccagcgggcuauuuaccacacagaaaacgccuacgucuccguggugagcucucauuauaaccgcagauuuaccccugagaucgcgaaacggccgaagguccgcgaucaggaaggcagaauuaauuacuauuggacgcugcuggagcccgaggacacaaucauuuucgaagccaacgggaaucucaucgcuccuugguacgccuuugcucugucccggggauucggcagcgggauuaucaccucuaacgccagcauggaugagugugacgcgaaaugccagacaccccaaggagccaucaauuccucucuuccuuuucagaacguucaccccgugaccauuggcgaauguccgaaguaugugcgcagcaccaaacugagaauggucacaggccuccggaauaucccuuccauucagagccgcgggcuguucggagcuaucgccggcuuuauugaagggggauggacgggcaugaucgaugggugguacggauaucaucaccagaacgaacaaggcucuggcuacgcugccgaccagaaguccacccagaaugccaucaacgggauuacaaauaaagugaacagcguuaucgagaagaugaauacccaguucacagcugugggaaaggaguucaacaaacuugaaagacggauggagaaucugaacaagaaagucgaugacggcuuucucgacauuuggaccuacaacgcggaacugcuggugcuccuggagaaugaacgcacgcuugauuuccacgacucuaacguuaagaaucuguaugagaaagugaagucccaacucaagaacaaugccaaagagaucgggaacggaugcuuugaguucuaccauaaguguaauaacgagugcauggaaagcgucaaaaauggcacauaugauuaccccaaguauuccgaggagucuaaacugaacagagaaaagauugacggggugaaacuugagagcaugggcgucuaccagauccuggcuaucuauuccaccguggccucuagccucguucugcuggugucccucggagccauuagcuuuuggaugugcucuaauggcucccugcagugucggaucugcauuuga

SEQ ID NO: 184569 - RNA, 1701 nt, Artificial Sequence; identical to SEQ ID NO: 184535
  derived and/or modified sequence opt5 from hemagglutinin__InfluenzaA__ABN50951

SEQ ID NO: 184570 - RNA, 1701 nt, Artificial Sequence
  derived and/or modified sequence opt5 from hemagglutinin__InfluenzaA__ABN50962
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcuucgggucuggaauuaucacauccaacgcgagcaugggcgagugugacgccaagugccagaccccucaaggcgcuauuaauucuagccugcccuuucagaacgugcacccggugaccaucggggaauguccuaaauacguccgguccacaaagcuccgcauggugacgggacugagaaauauccccucuauucagagccggggccuuuucggggccaucgcuggauuuauugagggcggguggaccggaaugaucgauggcugguauggcuaccaucaccagaacgaacaaggguccggauacgccgccgacaaaaagagcacacagaaugcuauugauggcaucaccaacaaaguuaauucugugaucgagaagaugaacacacaguucaccgcggucgggaaggaguucaauaaacuggaacgcagaauggagaaccucaauaagaaaguggacgauggauuucuggacauuuggacguauaacgccgaacugcucguucugcuugagaacgaacggacacuggacuuccacgauuccaaugugaagaaccucuacgagaaagucaagaaucagcugaagaacaaugcuaaagagaucggcaacgggugcuuugaguucuaucauaaguguaauaacgaaugcauggaaagcgugaaaaauggcaccuacgacuauccuaaguacucugaggaguccaaacuuaagcgcgaaaagauugauggagucaaacuggagagcaugggcguguaucaaauccucgccauuuacuccaccguugccucuagccuggugcugcucgucucccugggggcuaucucuuuuuggaugugcagcaacggaucccuucaguguagaaucugcauuuga

SEQ ID NO: 184571 - RNA, 1701 nt, Artificial Sequence; identical to SEQ ID NO: 183934
  derived and/or modified sequence opt5 from hemagglutinin__InfluenzaA__ABN50973

SEQ ID NO: 184572 - RNA, 1701 nt, Artificial Sequence; identical to SEQ ID NO: 183279
  derived and/or modified sequence opt5 from hemagglutinin__InfluenzaA__ABN50984

SEQ ID NO: 184573 - RNA, 1701 nt, Artificial Sequence; identical to SEQ ID NO: 183280
  derived and/or modified sequence opt5 from hemagglutinin__InfluenzaA__ABN50995

SEQ ID NO: 184574 - RNA, 1701 nt, Artificial Sequence
  derived and/or modified sequence opt5 from hemagglutinin__InfluenzaA__ABN51043
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagagauauuccuucucggaucagcaucuacuggaccauugugaaacccggggacauccugcugauuaauuccaccggaaaccucaucgcuccucgcggcuacuucaagauuagaagcgggaagucuuccaucaugcggagcgacgcccccaucggaaaauguaauucugaaugcauuacaccgaacggcagcaucccuaaugauaagcccuuucagaacgugaaucgcauuacguauggcgcuuguccuagauacgucaaacagaacacccugaaacuugccacagggaugcggaauguucccgagaagcaaacccgcggaaucuucggcgcgauugccggguuuaucgaaaacggaugggagggcaugguggacgggugguauggauucagacaccaaaauuccgagggcaucggccaggcugccgaucugaagucuacacaggcugccauuaaccagaucaaugggaaacucaaccggcugauuggaaagaccaacgaaaaguuccaccagaucgagaaagaauuuagcgagguggaaggccgcauucaggaccuugagaaguacgucgaggauacgaaaaucgaccugugguccuauaaugccgaacuccugguggcucuggagaaccaacauacaauugaucucaccgacagcgaaaugaauaagcuguucgagagaaccaaaaagcagcuucgggaaaacgcggaggauauggggaauggaugcuuuaagaucuaccacaaaugugacaacgccugcaucggcucuauuagaaaugggacauaugaucaugacguuuaccgcgacgaggcucugaacaaucgguuccagaucaagggcguggaacucaaauccggauacaaggauuggauucuguggaucagcuuugccauuucuugcuuccuucugugugucgugcuccugggcuuuaucaugugggccugccagaaagggaacaucagauguaauauuugcaucuga

SEQ ID NO: 184575 - RNA, 1701 nt, Artificial Sequence; identical to SEQ ID NO: 184420
  derived and/or modified sequence opt5 from hemagglutinin__InfluenzaA__ABN51054

SEQ ID NO: 184576 - RNA, 1701 nt, Artificial Sequence
  derived and/or modified sequence opt5 from hemagglutinin__InfluenzaA__ABN51066
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaagaagucuuccuggccuaaucauaccgugacaaaaggagucaccgcuagcugcucucacaacggcaaguccagcuucuacaaaaaucugcucuggcugacagagaagaacggccuuuaucccaaucugucuaaauccuacgugaacaauaaggaaaaggagguucucgugcuguggggaguccaucacccuagcaacauuggggaucagagaaccaucuaccacacggaaaacgccuauguguccguggucucuagccauuacucccggcgcuuuacaccggagaucgcgaaaagacccaagguucgggaccaggaaggccgcauuaauuauuacuggacccugcucgagccuggggauacaaucauuuucgaggccaacggaaaucugaucgcucccugguaugccuuugcucuuagcagaggcuucgggucuggaauuaucaccuccaacgccagcaugggcgacugugaugcgaaaugccagaccccucaaggcgccauuaauucuagccugcccuuucagaacgugcacccggugacaaucggggaauguccuaaguacguccgguccacgaaacuccgcauggugaccggacugagaaauauccccucuauucagagccggggccuuuucggggcuaucgccggauuuauugagggcggguggacaggaaugaucgacggcugguauggcuaccaucaccagaacgaacaaggguccggauacgcugccgauaagaaaagcacccagaaugccauugacggcaucacaaacaagguuaauucugugaucgagaagaugaacacccaguucacggcugucgggaaagaguucaauaagcuggaacgcagaauggagaaccucaauaaaaagguggaugacggauuucuggacauuuggacauauaacgcggaacugcucguucugcuugagaacgaacggacccuggauuuccacgacuccaaugugaaaaaccucuacgagaaggucaagaaucagcugaaaaacaaugccaaggaaaucggcaacgggugcuuugaguucuaucauaaauguaauaacgagugcauugaaagcgugaagaauggcaccuacgauuauccuaaauacucugaggaauccaaacuuaagcgcgagaagaucgacggagucaagcuggagagcaugggcguguaucaaauucucgcuaucuacuccacaguugccucuagccuggugcugcucgucucccugggggccaucggauuuuggaugugcucuaacggcagccuucaguguagaauuugcaucuga

SEQ ID NO: 184577 - RNA, 1698 nt, Artificial Sequence; identical to SEQ ID NO: 183320
  derived and/or modified sequence opt5 from hemagglutinin__InfluenzaA__ABN51077

SEQ ID NO: 184578 - RNA, 1698 nt, Artificial Sequence; identical to SEQ ID NO: 183323
  derived and/or modified sequence opt5 from hemagglutinin__InfluenzaA__ABN51088

SEQ ID NO: 184579 - RNA, 1701 nt, Artificial Sequence
  derived and/or modified sequence opt5 from hemagglutinin__InfluenzaA__ABN51099
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucgacuguacccucauugaugcccugcugggcgacccccauugcgauguguuucagaaugagacgugggaccucuucgucgaacggucuaaagccuuuagcaacuguuauccuuacgaugugcccgacuaugcuucccugcgcucucuuguugccagcuccgggacccuggaguucaucacagaaggauuuaccuggacaggcgugacccagaauggcgggagcaacgcuugcaagagaggaccuggcucuggguucuuuucccggcucaauuggcugacgaaaagcggaucuacauaccccguccuuaacgugaccaugccuaauaacgauaauuucgacaagcuguauauuuggggcguucaccauccguccacaaaccaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgauguucuggugauuaauagcaacgggaaucucaucgcgccucgcggauacuuuaaaaugagaacaggcaagucuuccauuaugcggagcgacgcccccaucgacaccuguauuucugagugcaucacaccgaacgggagcaucccuaaugauaaacccuuccagaacgugaauaagauuaccuacggagcuuguccuaaauaugucaagcagaacacgcugaaacuugccacaggcaugcgcaaugugcccgaaaagcagaccagagggcuguuuggagcuaucgccggcuucauugagaacggcugggaagggaugaucgacggaugguacggcuuucggcaccaaaauuccgaggggaccggacaggcggccgaucucaagucuacacaggcugccauugaccaaaucaacggcaaacugaaucgcguuaucgagaagaugaacgaaaaauuccaccagauugagaaggaguucagcgaaguggaagggagaauccaggaucuugagaaauaugucgaggacaccaagauugaucugugguccuacaaugcugaacuccugguggcccuggagaaccagcauacaaucgaccucacggauagcgaaaugaacaagcuguuugagaaaacccggagacaacuucgcgaaaaugccgaggacaugggcaacggaugcuucaagauuuaucacaaaugugauaaugcuugcaucgagucuauucggaacggcacauacgaccaugacguuuauagagaugaagcgcugaauaaccgcuuucagaucaaggggguggagcucaaauccggauacaaggacuggauccuguggauuagcuucgccaucucuugcuuucuucugugugucgugcuccugggcuucauuaugugggcuugccagcgggggaauaucagauguaacauuugcaucuga

SEQ ID NO: 184580 - RNA, 1701 nt, Artificial Sequence
  derived and/or modified sequence opt5 from hemagglutinin__InfluenzaA__ABN51110
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucaacuguacccucauugaugcccugcugggcgacccccauugcgauguguuucaggacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauaugggcaauggaugcuucaagauuuaucacaaaugugacaacgcuugcaucgagucuauucggaauggcaccuacgaccaugauguuuauagagacgaagcgcugaacaaucgcuuucagaucaaggggguggagcucaaauccggauacaaggauuggauccuguggauuagcuucgccaucucuugcuuucuucugugugucgugcuccugggcuucauuaugugggcuugccagcgggggaacaucagauguaauauuugcaucuga

SEQ ID NO: 184581 - RNA, 1701 nt, Artificial Sequence
  derived and/or modified sequence opt5 from hemagglutinin__InfluenzaA__ABN51121
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucaacuguacccucauugaugcccugcugggcgacccccauugcgauguguuucaggacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggaacguguccuaaauaugucaagcagaauacacugaaacuugcuaccggcaugcgcaacgugcccgaaaagcagaccagagggcuguuuggagccaucgcuggcuucauugagaauggcugggaagggaugaucgauggaugguacggcuuucggcaccaaaacuccgaggggacaggacaggccgcggaccucaagucuacccaggccgcuauugaucaaaucaauggcaaacugaaccgcguuaucgagaagacaaaugaaaaauuccaccagauugagaaggaguucagcgaaguggaagggagaauccaggaccuugagaaauaugucgaggauacgaagauugaccugugguccuacaacgccgaacuccugguggcucuggagaaucagcauaccaucgaucucacagaccuggaaaugaacaaacuuuuugagaagacccggagacaacugcgcgaaaacgccgaggauaugggcaauggaugcuucaagauuuaucacaaaugugacaacgccugcaucgagagcauucggaauggcacauacgaccaugauguuuauagagacgaagcucucaacaaucgcuuucagaucaaggggguggagcugaaaucuggauacaaggauuggauccuuuggauuuccuucgcgaucagcugcuuucugcucugugucgugcugcugggcuucauuaugugggccugccagcgggggaacaucagauguaauauuugcaucuga

SEQ ID NO: 184582 - RNA, 1701 nt, Artificial Sequence
  derived and/or modified sequence opt5 from hemagglutinin__InfluenzaA__ABN51132
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucaacuguacccucauugaugcccugcugggcgacccccauugcgauguguuucaggacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgccucuaucgauaccuguauuagcgagugcaucacacccaauggguccaucccgaacgacaaaccuuuccagaaugugaacaagauuaccuacggagcuugucccaaauaugucaagcagaauacgcugaaacuugccacaggcaugcgcaacgugccugaaaagcagaccagagggcuguuuggagcuaucgccggcuucauugagaauggcugggaagggaugaucgauggaugguacggcuuucggcaccaaaacucugaggggaccggacaggcggccgaccucaagagcacacaggcugccauugaucaaaucaauggcaaacugaaccgcguuaucgagaagaccaaugaaaaauuccaccagauugagaaggaguucuccgaaguggaagggagaauccaggaccuugagaaauaugucgaggauacaaagauugaccuguggagcuacaacgcugaacuccugguggcccuggagaaucagcauacgaucgaucucaccgacucugaaaugaacaagcuguuugagaaaacacggagacaacuucgcgaaaacgccgaggauaugggcaauggaugcuucaagauuuaucacaaaugugacaacgcuugcaucgaguccauucggaauggcaccuacgaccaugauguuuauagagacgaagcgcugaacaaucgcuuucagaucaaggggguggagcucaaaagcggauacaaggauuggauccuguggauuucuuucgccaucuccugcuuucuucugugugucgugcuccugggcuucauuaugugggcuugccagcgggggaacaucagauguaauauuugcaucuga

SEQ ID NO: 184583 - RNA, 1698 nt, Artificial Sequence; identical to SEQ ID NO: 183824
  derived and/or modified sequence opt5 from hemagglutinin__InfluenzaA__ABN51143

SEQ ID NO: 184584 - RNA, 1701 nt, Artificial Sequence
  derived and/or modified sequence opt5 from hemagglutinin__InfluenzaA__ABN51154
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcagaauuugcgacucuccgcaccagauccuggauggggagaauuguacgcucaucgacgcucugcugggagauccccauugcgacggcuuucagaacaaagaaugggaucucuucgucgagcggagcaaggccuauuccaauuguuacccuuaugacgugcccgauuacguuucucugcgcagccuuguggccuccagcgggacccuggaauuuaacaaugagucuuucaacuggacaggagucgcucaaaauggcaccuccagcgccugcaaaagacggucugacaaguccuuuuucagccgccucaacuggcugcaccagcuuaaguauaaauacccugcucugaaugugacaaugcccaacaaugagaaguuugauaaacucuauauuuggggcguucaucacccugggaccgacucugaucagaucucccuguacgcccaggcgagcggaagagugacggucuccacaaagcggucucaacagaccgugauuccgaacaucggcagcgggcccugggugcgcggagucuccagcagaauuucuaucuacuggacaauuguuaaaccuggcgacauccugcucaucaacuccaccgggaaucugauugcuccccggggauauuucaagauccgcagcggcaagucuagcauuaugagauccgacgccccuaucggcaaauguaacucugaaugcauuacccccaaugggagcaucccgaacgauaagccuuuucagaaugugaaccggaucacauacggacccuguccucgcuaugugaaacagaauacgcuuaagcuggccaccggcaugagaaacguccccgagaaacaaacacgggggauuuucggagcuaucgccggcuuuauugaaaaugggugggagggaaugauggacggcugguacggcuuccgccaccagaacuccgaggggaccggacaggcggccgaucucaagagcacacaagcugccaucaaucagauuaacggcaaacugaauagacuuaucgaaaagaccaacgagaaguuucaucagaucgaaaaagaguucucugaaguggaggggcggauucaggaccuggagaaguauguugaagauacgaaaaucgaccucugguccuacaaugcugagcugcugguggcccucgaaaaccaacacacaauugaucugaccgacagcgagaugaacaaacuuuucgaaagaaccaagaagcagcugcgcgagaaugccgaggauaugggaaacggcugcuuuaagaucuaucauaaaugugacaaugcuugcauugggucuauccggaacggcacauacgaucacgacgucuacagagacgaagcgcucaauaaccgcuuccagauuaagggaguggagcugaaauccggcuauaaggauuggauccuuuggaucagcuuugccauuuccugcuuccugcucuguaucguucugcugggguuuauuaugugggcuugccagaaaggaaauauccgguguaacauuugcaucuga

SEQ ID NO: 184585 - RNA, 1701 nt, Artificial Sequence
  derived and/or modified sequence opt5 from hemagglutinin__InfluenzaA__ABN59390
augaagaccaucauugcccugagcuacaucauuugccucguguucgcucagaaacugcccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggcgugcaccauccugggacggauaaugaccagaucuuucuguaugcgcaggccucuggacgcauuacaguuuccaccaagagaagccaacagacagugaucccgaacauuggcucccggccccgcgucagaaauaucccuucucggaucagcauuuacuggaccaucgugaaacccggggauauucuccugaucaacuccaccggaaaucugauugcuccucgcggcuacuucagaauccggagcgggaagucuuccaucaugcgcagcgacgcccccauuggaaaguguaacucugaaugcaucacaccgaauggcagcauuccuaacgacaaacccuuucagaaugugaacagaaucacguauggcgcuuguccucgguacgucaagcagaauacccucaaacuggccacagggaugcgcaacguucccgagaagcaaaccagaggaauuuucggcgcgaucgccggguuuaucgaaaauggaugggagggcaugguggaugggugguauggauuccggcaccagaacuccgagggcauuggccaggcugccgaccuuaaaucuacacaagcugccaucaaucagauuaacgggaagcugaacagacucaucggaaaaaccaaugaaaaguuccaccagauugagaaggaauuuagcgagguggaaggccgcauccaggaucuggagaaauacgucgaggacacgaagauugaucuuugguccuauaacgccgaacugcucguggcucuggagaaucaacauacaaucgaccugaccgauagcgaaaugaacaaacucuucgagcggaccaagaaacagcugagagaaaaugcggaggacauggggaacggaugcuuuaagaucuaccacaagugugauaaugccugcauuggcucuauccgcaacgggacauaugaccaugauguuuaccgggacgaggcucuuaauaacagauuccagauuaaaggcguggaacugaaguccggauacaaagacuggauccucuggauuagcuuugccaucucuugcuuccugcuuugugucgcccugcucggcuuuaucaugugggcuugccagaaggggaauauucgcuguaacaucugcauuuga

SEQ ID NO: 184586 - RNA, 1701 nt, Artificial Sequence
  derived and/or modified sequence opt5 from hemagglutinin__InfluenzaA__ABN59401
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgccccgcugcagcugggcaaauguaauauugccggguggauccucggaaacccugagugcgaaucccuguucucuaaaaagagcugguccuauauugcugagacccccaauucugaaaacggcacauguuaccccggguauuuugccgauuacgaggagcuucgggaacaacugagcuccgugagcucuuucgagcgcuuugaaaucuucccuaaggagagauccuggcccaagcauaauaucacccggggaguuacggcugccugcagccacaaaggcaagucuuccuuuuaucgcaaccuccuguggcuuaccgagaaaaauggcagcuacccuaaccugaauaagucuuaugugaacaauaaggaaaaagagguccucgugcuguggggaguucaucaccccuccaacauugaagaccagaagacacuguacagaaaagagaacgcguacgugagcgucguguccucuaauuauaaccggcgcuucaccccugaaaucgccgagagaccgaaggugcgggggcaggcuggccgcauuaauuacuauuggacacuccuggagcccggggauaccaucauuuuugaagccaacggaaaucuuaucgcuccuuggcacgccuucgcgcugagcagaggcuuuggguccggaauuaucacgagcaacgccucuauggacgagugugauacaaaaugccagacaccccaaggcgcuaucaauuccagccucccuuuccagaacauucaucccgucaccaucggcgaauguccgaaguacguucggucuaccaaacugcgcauggugaccgggcuuagaaauauuccuagcauccagucccggggacuguuuggcgccauugcuggguucaucgagggaggcuggacagggaugaucgacggaugguauggcuaccaccaucagaacgaacaaggcucuggguaugccgccgaucaaaagagcacgcagaaugcuauuaacggaaucaccaauaaggugaacuccgucauugagaaaaugaauacacaguuuaccgcggugggcaaggaguucaacaaacucgaaaagcgcauggagaaccugaauaaaaagguugacgauggguuccuggacaucuggacauacaacgccgaacuccuggugcuucuggagaaugaaagaacccucgacuuucacgauagcaacgucaagaaucuguacgagaaagugaagucucagcuuaaaaacaaugcuaaggagauuggaaacggcugcuucgaauuuuaucacaaauguaauaacgagugcauggaauccguuaagaaugggacguacgacuaucccaaguacagcgaggagucuaaacugaaccgggaaaagaucgauggcgugaaacucgaguccaugggagucuaucagauccuggccauuuacagcacaguggccuccucucugguccuccuggugagccuuggcgcuaucuccuucuggaugugcucuaaugggagccugcaguguagaauuugcaucuga

SEQ ID NO: 184587 - RNA, 1698 nt, Artificial Sequence
  derived and/or modified sequence opt5 from hemagglutinin__InfluenzaA__ABN59412
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugagccggggcuucggguccggaaucauuacaucuaacgccagcaugcacgaauguaauaccaagugccagacgccgcuuggcgcuaucaacuccagccugccuuaccagaauauccaucccguuacaauuggcgaguguccuaaauaugugcgcucugccaagcucagaauggugaccgggcugcggaacauccccuccauucagagccgcggacuguuuggcgcuaucgccggguucauugaaggaggcuggacagggaugaucgacggaugguacggcuaucaccaucaaaaugagcagggcucuggguacgccgcugaucagaaaagcacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuacaaugcugagcugcucguccugcuugaaaacgagcggacacuggaguuccacgacuccaaugugaagaaccucuaugaaaaaguuaagucucagcugaagaauaacgccaaagagauuggaaauggcugcuucgaauuuuaccacaagugugauaacgagugcauggaaagcgugcgcaaugggaccuaugacuaccccaaauauuccgaggagagcaagcugaacagagaaaaagucgauggcgugaagcucgagucuaugggaaucuaccagauccuggccauuuauuccacagucgcuagcucucuugugcugcucguuucccugggcgccaucagcuucuggaugugcuccaaugggucucugcaaugucggauuugcaucuga

SEQ ID NO: 184588 - RNA, 1701 nt, Artificial Sequence
  derived and/or modified sequence opt5 from hemagglutinin__InfluenzaA__ABN59423
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaaaaucagaagacaauuuacagaaaagagaacgccuacgucagcgugguguccagcaacuauaaucggcgcuucaccccugaaaucgcggagagaccgaagguccgggaccaggaggggcgcauuaacuacuauuggacacugcucgaacccggcgauaccaucauuuuugaggccaaugggaaccugaucgcuccuugguacgccuucgcucuuucuagaggauuuggcuccgggauuaucacgagcaaugccucuauggacgaaugugauacaaaaugccagacaccccaaggagcgaucaacagcucccugccuuuccagaauguucaccccgugaccauuggcgaguguccgaaguaugugcggucuaccaaacuccgcauggucaccggccugagaaacaucccuagcauucagucccgggggcuuuuuggagccaucgcuggcuucauugaagggggauggacaggcaugaucgacgggugguacggauaucaucaccagaaugagcaaggcagcggcuacgccgcugaucagaagucuacgcagaacgccaucaaugggauuaccaacaagguuaauuccgugaucgagaaaaugaacacacaguuuaccgccgugggaaaggaguucaauaaacuggaaaagcgcauggaaaaccucaacaaaaaggucgacgauggcuuccuggacauuuggacauacaaugcugagcugcucgugcugcuugaaaacgagagaacccuggacuuucaugauagcaauguuaagaaccucuaugagaaagugaagucucaacugaaaaauaacgcgaaggaaaucgggaauggaugcuucgaguuuuaccacaaauguaacaaugaaugcauggaguccgucaagaacggcacguaugacuaccccaaguauagcgaggaauccaaacuuaaucgggagaagauugauggggugaaacuggaaucuaugggcgucuaccagauccucgccaucuauagcacaguggcuuccucucugguucugcucgugagccugggagccauuuccuucuggaugugcagcaacggcucucuucaguguagaaucugcauuuga

SEQ ID NO: 184589 - RNA, 1701 nt, Artificial Sequence; identical to SEQ ID NO: 183790
  derived and/or modified sequence opt5 from hemagglutinin__InfluenzaA__ABO32656

SEQ ID NO: 184590 - RNA, 1701 nt, Artificial Sequence
  derived and/or modified sequence opt5 from hemagglutinin__InfluenzaA__ABO32667
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuuccgggcgcguuaccgugucuacgaagagaagccaacagacagucauuccgaacaucggcucccggcccugggugcgcgaugugagcucuagaauuuccaucuacuggaccauugucaaaccuggggacauccugcucaucaauagcacaggaaaccugauugcuccccggggcuauuucaagauccgcucuggaaagagcuccauuaugagaucugacgccccuaucgggaaauguaauagcgaaugcauuacccccaacggcuccaucccgaaugauaagccuuuucagaacguuaaucggaucaccuacggcgccuguccccgcuaugugaaacagaacacacuuaagcuggcgacggggaugagaaaugugccugagaaacaaacccggggaauuuucggcgccaucgcuggguuuauugaaaacggaugggagggcauggucgacgggugguacggauuccgccaccagaauagcgagggcacaggccaggccgcugaucucaagucuacccaagccgccaucaaccagauuaaugggaaacugaacagacuuaucggaaagacaaaugaaaaguuucaucagaucgagaaagaguucuccgaaguggaaggccggauucaggaccuggagaaguauguugaggauaccaaaaucgaccucuggagcuacaacgcugaacugcugguggcgcucgagaaccaacacacgauugaucugacagacucugaaaugaauaaacuuuucgagagaaccaagaagcagcugcgcgaaaacgccgaggauauggggaauggaugcuuuaagaucuaucauaaaugugacaacgcuugcauuggcuccauccggaaugggaccuacgaucacgacgucuacagagacgaggcccucaacaaucgcuuccagauuaagggcguggaacugaaaagcggauauaaggauuggauccuuuggaucuccuuugccauuucuugcuuccugcucuguguugugcugcugggcuuuaucaugugggcuugccagaaagggaacauucgguguaauaucugcauuuga

SEQ ID NO: 184591 - RNA, 1698 nt, Artificial Sequence
  derived and/or modified sequence opt5 from hemagglutinin__InfluenzaA__ABO32678
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacuccgucaucgaaaagaugaauacacaguucaccgcgguggggaaagaguucagcaaacuggagagacggauggaaaaccuccacaagaagguugacgauggauuucuggacauuuggacauacaaugccgagcuucuggugcuccuggaaaacgagcgcacccuugacuuccaugauucuaacgucaaaaaucuguaugaaaaggugaaaucccaacucaagaacaaugcuaaagagaucggcaacgggugcuuugaguucuaccacaaguguaaugacgaaugcauggagagcgucaagaacggcacguaugauuaccccaaauauucugaagaguccaagcugaauagagagaaaauugacggagugaagcuggaaagcaugggcguuuaccagauccucgccauuuauuccacaguggccucuagccugguccuucuggugucccucggggcuaucucuuuuuggaugugcagcaacggaucccugcagugucggaucugcauuuga

SEQ ID NO: 184592 - RNA, 1701 nt, Artificial Sequence
  derived and/or modified sequence opt5 from hemagglutinin__InfluenzaA__ABO32692
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccauuucuugcuuccuucugugugucgugcuccugggguuuaucaugugggccugccagaaaggaaauaucagauguaacauuugcaucuga

SEQ ID NO: 184593 - RNA, 1701 nt, Artificial Sequence; identical to SEQ ID NO: 184457
  derived and/or modified sequence opt5 from hemagglutinin__InfluenzaA__ABO32751

SEQ ID NO: 184594 - RNA, 1701 nt, Artificial Sequence; identical to SEQ ID NO: 184457
  derived and/or modified sequence opt5 from hemagglutinin__InfluenzaA__ABO32762

SEQ ID NO: 184595 - RNA, 1701 nt, Artificial Sequence; identical to SEQ ID NO: 184479
  derived and/or modified sequence opt5 from hemagglutinin__InfluenzaA__ABO32775

SEQ ID NO: 184596 - RNA, 1701 nt, Artificial Sequence; identical to SEQ ID NO: 183267
  derived and/or modified sequence opt5 from hemagglutinin__InfluenzaA__ABO32790

SEQ ID NO: 184597 - RNA, 1701 nt, Artificial Sequence
  derived and/or modified sequence opt5 from hemagglutinin__InfluenzaA__ABO32803
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacgcuugaguuuaacaaugaaucuuucaacuggaccggcgucacacagaauggcaccuccagcgccugcaagcgcagaucuaacaauuccuuuuucagccggcugaacuggcucacacaucugaaguuuaaauauccugcucuuaaugugaccaugcccaacaacgagaaguucgacaaacuguacaucuggggaguucaccauccugggacggauaaugaccagauuucucucuaugcccaggcguccggccgcaucacagugagcaccaagagaucccaacagacagucauuccgaacaucgggucucggccccgcgugagagauauuccuagccggaucuccaucuacuggaccauugugaaacccggagacacccugcugaucaauagcacaggcaaccucauugccccucgcggguacuuuaagaucagaucuggaaaguccagcauuaugcggucugacgcucccaucgauaaauguaauagcgagugcaucacgccgaacggcuccauuccuaaugacaagcccuuccagaacgucaaucgcaucaccuauggcgccuguccuagauacguuaaacagaacacacugaaacuugcuaccgggaugcggaaugugcccgaaaaacaaacacgcggaauuuuuggcgccaucgcgggguucauugagaacggaugggaaggcaugguggaugggugguauggauuuagacaccagaauagcgagggcaucggccaggccgcugaccugaagucuacccaagccgcuaucaaccagauuaaugggaaacucaaccggcugaucggaaagacgaacgagaaguuccaccagauugaaaaagaguucuccgaagucgagggcagaauccaggaucuugaaaaguacguggaggacacaaaaauugaucuguggagcuauaaugccgagcuccugguugcccuggaaaaccaacauaccaucgaccucaccgauucugagaugaauaagcuguuugaacgcacaaagaagcagcuucgggagaacgcugaagacauggggaauggaugcuucaagauuuaccacaaaugugauaacgcgugcaucggcuccaucagaaaugggaccuaugaccaugacguguaccgcgaugaggcccugaacaaucgguuucagauuaagggcgucgagcucaaaagcggauacaaggacuggauccuguggauuucuuucgcuaucuccugcuuucuucuguguguggcccuccugggcuucauuaugugggccugccagaaagggaacaucagauguaauaucugcauuuga

SEQ ID NO: 184598 - RNA, 1701 nt, Artificial Sequence; identical to SEQ ID NO: 183657
  derived and/or modified sequence opt5 from hemagglutinin__InfluenzaA__ABO32816

SEQ ID NO: 184599 - RNA, 1701 nt, Artificial Sequence; identical to SEQ ID NO: 183280
  derived and/or modified sequence opt5 from hemagglutinin__InfluenzaA__ABO32827

SEQ ID NO: 184600 - RNA, 1701 nt, Artificial Sequence
  derived and/or modified sequence opt5 from hemagglutinin__InfluenzaA__ABO32838
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaagaugggaucuguucgucgaacggagcaaggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggagugcaccauccugggacggauaaugaccagauuuuucucuaugcgcaggccucuggcagaaucacaguuuccaccaaacggagccaacagacagugauuccgaacaucgggucccgccccagaguccggaauauuccuucucgcaucagcaucuacuggaccauugugaagcccggagauauccugcugauuaacuccaccggcaaucucaucgcuccuagaggguacuucaaaauucggagcggaaagucuuccaucaugcgcagcgacgcccccaucggcaaguguaacucugagugcauuacaccgaauggcagcaucccuaacgacaaacccuuucagaaugugaacagaauuacguauggggcuuguccucgguacgucaagcagaauacccugaaacuugccacaggaaugcgcaacguucccgaaaagcaaaccagaggcaucuucggggcgauugccggauuuaucgagaauggcugggaagggaugguggauggaugguauggcuuccggcaccagaacuccgagggcaucgggcaggcugccgaccugaaaucuacacaagcugccauuaaucagaucaacggaaagcucaacagacugauuggcaaaaccaaugagaaguuccaccagaucgaaaaggaguuuagcgaaguggaggggcgcauucaggaucuugaaaaauacgucgaggacacgaagaucgaucugugguccuauaacgccgagcuccugguggcucuggaaaaucaacauacaauugaccucaccgauagcgagaugaacaaacuguucgaacggaccaagaaacagcuuagagagaaugcggaagacaugggaaacggcugcuuuaagaucuaccacaagugugauaaugccugcaucgggucuauucgcaacggcacauaugaccaugauguuuaccgggacgaggcucugaauaacagauuccagaucaaaggaguggagcucaaguccggcuacaaagacuggauucuguggaucagcuuugccauuucuugcuuccuucugugugucgcccuccugggguuuaucaugugggcuugccagaagggaaauauccgcuguaacauuugcaucuga

SEQ ID NO: 184601 - RNA, 1701 nt, Artificial Sequence; identical to SEQ ID NO: 184600
  derived and/or modified sequence opt5 from hemagglutinin__InfluenzaA__ABO32849

SEQ ID NO: 184602 - RNA, 1701 nt, Artificial Sequence
  derived and/or modified sequence opt5 from hemagglutinin__InfluenzaA__ABO32860
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaagaugggaucuguucgucgaacggagcaaggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggagugcaccauccugggacggauaaugaccagauuuuucucuaugcgcaggccucuggcagaaucacaguuuccaccaaacggagccaacagacagugauuccgaacaucgggucccgccccagaguccgggauauuccuucucgcaucagcaucuacuggaccauugugaagcccggagacauccugcugauuaauuccaccggcaaccucaucgcuccuagaggguacuucaaaauucggagcggaaagucuuccaucaugcgcagcgacgcccccaucggcaaguguaauucugagugcauuacaccgaacggcagcaucccuaaugauaaacccuuucagaacgugaauagaauuacguauggggcuuguccucgguacgucaagcagaacacccugaaacuugccacaggaaugcgcaauguucccgaaaagcaaaccagaggcaucuucggggcgauugccggauuuaucgagaacggcugggaagggaugguggacggaugguauggcuuccggcaccaaaauuccgagggcaucgggcaggcugccgaucugaaaucuacacaggcugccauuaaccagaucaauggaaagcucaacagacugauuggcaaaaccaacgagaaguuccaccagaucgaaaaggaguuuagcgaaguggaggggcgcauucaggaccuugaaaaauacgucgaggauacgaagaucgaccugugguccuauaaugccgagcuccugguggcucuggaaaaccaacauacaauugaucucaccgacagcgagaugaauaaacuguucgaacggaccaagaaacagcuuagagagaacgcggaagauaugggaaauggcugcuuuaagaucuaccacaagugugacaacgccugcaucgggucuauucgcaauggcacauaugaucaugacguuuaccgggacgaggcucugaacaauagauuccagaucaaaggaguggagcucaaguccggcuacaaagauuggauucuguggaucagcuuugccauuucuugcuuccuucugugugucgcccuccugggguuuaucaugugggcuugccagaagggaaacauccgcuguaauauuugcaucuga

SEQ ID NO: 184603 - RNA, 1701 nt, Artificial Sequence; identical to SEQ ID NO: 184585
  derived and/or modified sequence opt5 from hemagglutinin__InfluenzaA__ABO32871

SEQ ID NO: 184604 - RNA, 1701 nt, Artificial Sequence
  derived and/or modified sequence opt5 from hemagglutinin__InfluenzaA__ABO32882
augaagaccaucauugcccugagcuacaucauuugccucguguucgcucagaaacugcccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcaagcgcagaucuaacaauuccuuuuucagccggcuuaacuggcugacacaucucaaguuuaaauauccugcccugaaugucaccaugcccaacaacgagaaguucgacaaacuuuacauuuggggcgugcaccauccugggacggauaaugaccagaucuuuccguaugcgcaggccucuggacgcauuacaguuuccaccaagagaagccaacagacagugauccccaacauuggcucccggccucgcgucagaaauauccccucucggaucagcauuuacuggaccaucgugaaaccuggggauauucugcucaucaacuccaccggaaaucugauugcuccccgcggcuacuucagaauccggagcgggaagucuuccaucaugcgcagcgacgccccgauuggaaaguguaacucugaaugcaucacaccuaauggcagcauucccaacgacaaaccuuuucagaaugugaacagaaucacguauggcgcuuguccccgguacgucaagcagaauacccugaaacucgccacagggaugcgcaacguucccgagaagcaaaccagaggaauuuucggcgcgaucgccggguuuaucgaaaauggaugggagggcaugguggaugggugguauggauuccggcaccagaacuccgagggcauuggccaggcugccgaccugaaaucuacacaagcugccaucaaucagauuaacgggaaacuuaacagacugaucggaaagaccaaugaaaaguuccaccagauugagaaggaauuuagcgagguggaaggccgcauccaggaucucgagaaauacgucgaggacacgaagauugaucugugguccuauaacgccgaacuucugguggcucucgagaaucaacauacaaucgaccugaccgauagcgaaaugaacaaacuguucgagcggaccaagaaacagcucagagaaaaugcggaggacauggggaacggaugcuuuaagaucuaccacaagugugauaaugccugcauuggcucuauccgcaacgggacauaugaccaugauguuuaccgggacgaggcucugaauaacagauuccagauuaaaggcguggaacuuaaguccggauacaaagacuggauccuguggauuagcuuugccaucucuugcuuccuccugugugucgcccuucugggcuuuaucaugugggcuugccagaaggggaauauucgcuguaacaucugcauuuga

SEQ ID NO: 184605 - RNA, 1701 nt, Artificial Sequence
  derived and/or modified sequence opt5 from hemagglutinin__InfluenzaA__ABO32893
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcguggaacucaaauccggauacaaggacuggauucuguggaucagcuuugccauuucuugcuuccuucugugugucgugcuccugggcuuuaucaugugggccugccagaaagggaauaucagauguaacauuugcaucuga

SEQ ID NO: 184606 - RNA, 1701 nt, Artificial Sequence; identical to SEQ ID NO: 184605
  derived and/or modified sequence opt5 from hemagglutinin__InfluenzaA__ABO32904

SEQ ID NO: 184607 - RNA, 1701 nt, Artificial Sequence; identical to SEQ ID NO: 184420
  derived and/or modified sequence opt5 from hemagglutinin__InfluenzaA__ABO32915

SEQ ID NO: 184608 - RNA, 1701 nt, Artificial Sequence; identical to SEQ ID NO: 184420
  derived and/or modified sequence opt5 from hemagglutinin__InfluenzaA__ABO32926

SEQ ID NO: 184609 - RNA, 1701 nt, Artificial Sequence
  derived and/or modified sequence opt5 from hemagglutinin__InfluenzaA__ABO32937
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaagaaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggagugacacagaauggcaccuccagcucuugcaaaagacgguccaacaauagcuuuuucucucgccugaacuggcucacacaucugaaguuuaaguauccugcucuuaaugucaccaugcccaacaacgagaaauucgacaagcuguacaucuggggcgugcaccauccugggacggauaaugaccagauuuuucucuaugcccaggcguccggaagaaucacaguuagcaccaaacggucccaacagacagugauuccgaacaucggcucucgccccagaguccggaauauuccuagccgcaucuccaucuacuggaccauugugaagcccggggauauccugcugauuaacagcaccggaaaucucaucgccccuagaggcuacuucaaaauucggucugggaaguccagcaucaugcgcucugacgcucccaucggaaaguguaacagcgaaugcauuacaccgaauggcuccaucccuaacgacaaacccuuucagaaugugaacagaauuacguauggcgccuguccucgguacgucaagcagaauacccugaaacuugcuacagggaugcgcaacguucccgagaagcaaaccagaggaaucuucggcgccauugcgggguuuaucgaaaauggaugggagggcaugguggaugggugguauggauuccggcaccagaacucugagggcaucggccaggccgcugaccugaaaagcacacaagccgcuauuaaucagaucaacgggaagcucaacagacugauuggaaaaaccaaugaaaaguuccaccagaucgagaaggaauuuuccgagguggaaggccgcauucaggaucuugagaaauacgucgaggacacgaagaucgaucuguggagcuauaacgccgaacuccugguggcccuggagaaucaacauacaauugaccucaccgauucugaaaugaacaaacuguucgagcggaccaagaaacagcuuagagaaaaugcugaggacauggggaacggaugcuuuaagaucuaccacaagugugauaaugcgugcaucggcuccauucgcaacgggacauaugaccaugauguuuaccgggacgaggcccugaauaacagauuccagaucaaaggcguggaacucaagagcggauacaaagacuggauucuguggaucucuuuugcuauuuccugcuuccuucugugugucgcccuccugggcuuuaucaugugggccugccagaaggggaauauccgcuguaacauuugcaucuga

SEQ ID NO: 184610 - RNA, 1698 nt, Artificial Sequence
  derived and/or modified sequence opt5 from hemagglutinin__InfluenzaA__ABO32948
augagagccaagcugcucgugcugcuuugcaccuucacagcuacguacgccgacaccaucuguauuggcuaucacgcgaacaauagcacagauaccgucgacacaguucuggagaaaaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaggagucuuggagcuacauuguugaaaccccgaaucccgagaacggcacguguuauccuggguacuuugccgacuaugaggaacugcgggagcaacucuccucugugagcuccuucgaacgcuuugagaucuuccccaaaggaagcucuuggccuaaucauaccgucacaggcguguccgcuagcugcucucacaacggcaaguccagcuuuuacagaaaucugcuuuggcugaccgggaagaacggacucuaucccaaucugucuauguccuacguuaacaauaaagagaaggaagugcugguccucuggggcgugcaucacccuccgaacaucggggaucagcgggcccuguaccacacagagaacgcuuaugugagcgucguuuccucucauuacagccgcagauucacccccgaaauugccaaacggccuaaggugcgcgaccaggagggaagaaucaauuauuacuggacgcuucuggaacccggcgauacaauuaucuuugaggcgaacgggaaucucauugccccuugguaugcuuucgcccugucccggggauuuggcagcggcaucauuaccucuaacgcucccauggacgagugugaugccaaaugccagacaccgcaaggggcgaucaauuccagccuuccuuuccagaacgugcaccccgucaccaucggagaauguccuaaguacgugcgcucugccaagcugagaaugguuaccggccuccggaauauucccagcauccagucccgcgggcuguuuggagcuauugccggcuucaucgaagggggauggacaggcaugguggacggcugguauggguaccaucaccagaacgaacaaggaucuggcuacgcugccgaucagaaaagcacgcagaaugccauuaacgggaucaccaauaaggucaacuccgugaucgagaaaaugaauacacaguuuaccgcuguuggaaaggaguucaacaaacuggagagacggauggagaaucucaacaagaaaguggacgauggcuuccuggacauuuggacauauaacgcggaacuucugguccuccuggagaaugaacgcacccuugacuuucacgauagcaacgugaagaaucuguacgagaaggucaaaucucaacucaagaacaaugccaaagaaaucgggaacggcugcuucgaguuuuaucauaaguguaauaacgagugcauggaauccgugaaaaauggaacguacgacuaucccaaguacagcgaggaaucuaagcugaacagagagaaaauugauggcguuaagcuggaguccauggggguguaucagauccucgcuauuuacagcacagucgccuccucucuggugcuucugguuagccucggagccaucuccuucuggaugugcucuaauggcagccugcagugucggaucugcauuuga

SEQ ID NO: 184611 - RNA, 1698 nt, Artificial Sequence
  derived and/or modified sequence opt5 from hemagglutinin__InfluenzaA__ABO32959
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuagauccuacguuaacaauaaggaaaaagaggugcugguccucuggggagugcaucacccuccgaacaucggcgaucagcgggcccuguaccacacagaaaacgcuuaugugagcgucguuuccucucauuacagccgcagauucacccccgagauugccaagcggccuaaagugcgcgaccaggaagggagaaucaauuauuacuggacgcuucuggagcccggagauacacucauuuuugaggcgaacggcaaucugaucgccccuugguaugcuuucgcccuuucccggggguuuggaagcggcauuaucaccucuaacgcucccauggacgaaugugaugccaagugccagacaccgcaaggcgcgauuaauuccagccugccuuuccagaacgugcaccccgucaccaucggggaguguccuaaguacgugcgcucuaccaaacucagaaugguuacaggacugcggaauauccccagcauucagucccgcggccuguuuggggccaucgcuggauucauugaaggcggguggacgggaaugguggacggcugguauggcuaccaucaccagaacgagcaagggucuggauacgccgcugaucaaaagagcacccagaaugccaucaacggcauuacaaauaaagucaacuccgugaucgaaaagaugaauacccaguuuacagccguugggaaagaguucaacaagcucgagagacggauggaaaaucugaacaaaaagguggacgauggauuccuugacaucuggaccuauaacgcugagcugcucguccugcuugaaaaugagcgcacgcuggacuuucacgauagcaacgugaagaaucucuacgaaaaagucaagucucagcugaaaaacaaugcgaaggagauuggcaacgggugcuucgaguuuuaucauaaauguaauaacgaaugcauggaguccgugaagaauggcacauacgacuaucccaaguacagcgaagagucuaaacugaacagagagaagaucgauggaguuaaacucgaauccaugggcguguaucagauucuggccaucuacagcaccgucgcuuccucucuugugcugcucguuagccugggggccauuuccuucuggaugugcucuaauggaagccugcagugucggaucugcaucuga

SEQ ID NO: 184612 - RNA, 1698 nt, Artificial Sequence; identical to SEQ ID NO: 184228
  derived and/or modified sequence opt5 from hemagglutinin__InfluenzaA__ABO32970

SEQ ID NO: 184613 - RNA, 1701 nt, Artificial Sequence
  derived and/or modified sequence opt5 from hemagglutinin__InfluenzaA__ABO32981
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucaaggaccagaaaacaauuuacagaaaggaaaaugccuacgucagcgugguguccagcaacuauaaccggcgcuucaccccugagaucgcggaaagaccgaaaguccgggaucaggccgggcgcauuaauuacuauuggacacugcucgagcccggcgacaccaucauuuuugaggcuaacgggaaucugaucgccccuugguacgcuuucgcccuuucuagaggauuuggcuccgggauuaucacgagcaacgcgucuauggaugaaugugacacaaagugccagacaccccaaggagccaucaauagcucccugccuuuccagaacguucaccccgugaccauuggcgaguguccgaaauaugugcggucuaccaagcuccgcauggucaccggccugagaaauaucccuagcauucagucccgggggcuuuuuggagcuaucgccggcuucauugaagggggauggacaggcaugaucgaugggugguacggauaucaucaccagaacgagcaaggcagcggcuacgcugccgaccagaagucuacgcagaaugccaucaacgggauuaccaauaaagugaacuccguuaucgaaaagaugaauacacaguuuaccgcugugggaaaagaguucaacaagcuggagaaacgcauggaaaaucucaacaagaaggucgaugacggcuuccuggacauuuggacauacaacgcggagcugcucgugcugcuugaaaaugagagaacccuggauuuucaugacagcaacguuaaaaaucucuaugaaaaggugaaaucucaacugaagaacaaugccaaagagaucgggaacggaugcuucgaguuuuaccacaaguguaauaacgaaugcauggaguccgucaagaauggcacguaugauuaccccaaauauagcgaagaguccaaacuuaaccgggagaagauugacggggugaagcuggaaucuaugggcgucuaccagauccucgcuaucuauagcacaguggccuccucucugguucugcucgugagccugggagccauuuccuucuggaugugcagcaauggcucucuucaguguagaaucugcauuuga

SEQ ID NO: 184614 - RNA, 1701 nt, Artificial Sequence
  derived and/or modified sequence opt5 from hemagglutinin__InfluenzaA__ABO32992
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcaugacguuacccggggagugacggcuucuugcucccacaaaggcaagagcucuuuuuaucgcaaccuccuguggcuuaccgagaaaaauggcuccuacccuaaccugagcaaguccuaugucaauaacaaggaaaaagaggugcucguucuguggggagugcaucaccccucuaauaucgaagaucagaagacaauuuacagaaaagagaacgccuacgucagcgugguguccagcaauuauaaccggcgcuucaccccugaaaucucugagagaccgaagguccgggaccagaaagggcgcauuaacuacuauuggacacugcucgagcccggcgauaccaucauuuuugaagcgaaugggaaccugaucgccccuugguacgcuuucgcccuuuccagaggauuuggcagcgggauuaucacgucuaaugcuagcauggacgagugugauacaaagugccagacaccccaaggagccaucaacuccucucugccuuuccagaauguucaccccgugaccauuggcgaauguccgaaauaugugcggagcaccaagcuccgcauggucaccggccugagaaacaucccuuccauucagagccgggggcuuuuuggagcgaucgccggcuucauugaagggggauggacaggcaugaucgacgggugguacggauaucaucaccagaaugaacaaggcucuggcuacgcugccgaucagaaguccacgcagaacgcuaucaaugggauuaccaacaaagugaauagcguuaucgagaagaugaacacacaguuuaccgccgugggaaaagaguucaauaagcuggaaaaacgcauggagaaccucaauaagaaggucgacgacggcuuccuggauauuuggacauacaacgccgaacugcucgugcugcuugagaacgaaagaacccuggacuuucaugauucuaauguuaaaaaccucuaugagaaggugaaaucccaacugaagaauaacgcuaaagagaucgggaauggaugcuucgaauuuuaccacaaguguaacaaugagugcauggaaagcgucaagaacggcacguaugacuaccccaaauauuccgaggagucuaaacuuaaucgggagaagauugauggggugaagcuggagagcaugggcgucuaccagauccucgcgaucuauuccacaguggccucuagccugguucugcucgugucccugggagcuauuagcuucuggaugugcucuaacggcucccuucaguguagaaucugcauuuga

SEQ ID NO: 184615 - RNA, 1701 nt, Artificial Sequence
  derived and/or modified sequence opt5 from hemagglutinin__InfluenzaA__ABO33006
augaaggccaagauccuggugcuccugugcgcucuuagcgccaccgacgcggauacaauuuguaucggcuaccacgcuaacaauuccacggacaccgucgauacaguucuggagaagaacgugaccgugacacauucugucaaucuccuggaagacagccacaacgggaaacuuugcagacugaagggaauugcuccccuccagcugggcaaauguuccaucgccggguggauucugggaaauccugagugcgaaucucucuucagcaagaaguccuggucuuauaucgccgagaccccgaacagcgaaaauggcacauguuaccccggguauuuugccgauuacgaggagcugcgggaacaacuuuccagcgugucuuccuucgagcgcuuugaaaucuucccuaaagagagaagcuggcccaagcauaacguuacccggggagugacggcuucuugcucccacaaaggcaagagcucuuuuuaucgcaaucugcucuggcugaccgagaaaaacggcuccuacccuaaucuuagcaaguccuaugucaacaauaaggaaaaagaggugcugguucucuggggagugcaucaccccucuaacauugaagaccagaagacaaucuacagaaaagagaaugccuacgucagcgugguguccagcaacuauaaccggcgcuucaccccugaaauuucuaagagaccgaaaguccgggaucaggaggggcgcaucaauuacuauuggacacugcuggagcccggcgacaccauuaucuuugaagcgaacgggaaucucauugccccuugguacgcuuucgcccuguccagaggauuuggcagcgggaucaucacgucuaacgcuagcauggaugagugugacacaaagugccagacaccccaaggagccauuaauuccucucuuccuuuccagaacguucaccccgugaccaucggcgaauguccgaaauaugugcggagcaccaagcugcgcauggucaccggccucagaaauauuccuuccauccagagccgggggcuguuuggagcgauugccggcuucaucgaagggggauggacaggcaugaucgaugggugguacggauaucaucaccagaacgaacaaggcucuggcuacgcugccgaccagaaguccacgcagaaugcuauuaacgggaucaccaauaaagugaacagcguuauugagaagaugaauacacaguuuaccgccgugggaaaagaguucaacaaacuugaaaagcgcauggagaaucugaacaagaaggucgaugacggcuuccucgacaucuggacauacaacgccgaacugcuggugcuccuggagaaugaaagaacccuugauuuucaugacucuaacguuaaaaaucuguaugagaaggugaaaucccaacucaagaacaaugcuaaagagauugggaacggaugcuucgaauuuuaccacaaguguaauaacgagugcauggaaagcgucaagaauggcacguaugauuaccccaaauauuccgaggagucuaagcugaaccgggagaaaaucgacggggugaaacuugagagcaugggcgucuaccagauccuggcgauuuauuccacaguggccucuagccucguucugcuggugucccucggagcuaucagcuucuggaugugcucuaauggcucccugcaguguagaauuugcaucuga

SEQ ID NO: 184616 - RNA, 1701 nt, Artificial Sequence
  derived and/or modified sequence opt5 from hemagglutinin__InfluenzaA__ABO33025
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaucauaacguuaccaaaggagugacggcuucuugcucccacaagggcaaaagcucuuuuuaucgcaaucuccuguggcuuaccgagaagaacggcuccuacccuaaucugagcaaguccuaugucaacaauaaagaaaaggaggugcucguucuguggggagugcaucaccccucuaacaucaaagaccagagaacaauuuaccggaaggaaaacgccuacgucagcgugguguccagccacuauaaucgcagauucaccccugagaucgcgaaacggccgaagguccgcgaucaggaagggagaauuaacuacuauuggacacugcucgagcccggcgacaccaucauuuuugaggccaaugggaaccugaucgcuccuugguacgccuucgcucuuucucggggauuuggcuccgggauuaucacgagcaaugccucuauggaugaaugugacgcgaaaugccagacaccccaaggagccaucaacagcucccugccuuuccagaauguucaucccgugaccauuggcgaguguccgaaguaugugcgcucuacaaagcucagaauggucaccggccugcggaacaucccuagcauucagucccgcgggcuuuuuggagcuaucgccggcuucauugaagggggauggaccggcaugaucgaugggugguacggauaucaccaucagaaugagcaaggcagcggcuacgcugccgaccagaaaucuacacaguccgccaucaacgggauuacgaauaaggugaacagcaucauugaaaagaugaauacccaguuuacagcuguuggaaaagaguucaacaaacuggagaagagaauggaaaaucucaacaagaaaguggaugacggcuuccuggacaucuggaccuacaacgcggagcugcucguccugcuugaaaaugagcggacacuggauuuucacgacucuaacgugaagaaucucuaugaaaaaguuaagucccaacugaaaaacaaugccaaggagauugggaacggaugcuucgaguuuuaccacaaguguaauaacgaaugcauggagagcgugaaaaauggcaccuaugauuaccccaaguauuccgaagagucuaaacuuaaccgcgagaagaucgacggggucaaacuggaaagcaugggcguguaccagauccucgcuauuuauuccacggucgccucuagccuggugcugcucguuucccugggagccaucagcuucuggaugugcucuaauggcucccuucaguguagaauuugcaucuga

SEQ ID NO: 184617 - RNA, 1701 nt, Artificial Sequence
  derived and/or modified sequence opt5 from hemagglutinin__InfluenzaA__ABO33036
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcaauucuccgcaccagauccuggacggggagaacuguacccucaucgaugcccugcugggagacccccauugcgauggcuuucagaauaaagaaugggaccucuucgucgagcggcgcaaggccuauagcaacuguuacccuuaugaugugcccgacuacgcuucccugagaucucuuguugccagcuccgggacgcuggaauuuaauaacgagagcuucaauuggaccggaguggcucaaaacggcacaucuuccgccugcaaacggcgcagcauuaaguccuuuuucucuagacucaauuggcugcaccagcuuaaguauaaauacccugcgcugaacgucaccaugcccaauaacgagaaguuugauaaacucuauaucuggggcgugcaucacccuagcacagacucugaucagauuucccuguacgcccaggcuagcgggcggguuaccguguccacgaagcgcucucaacagacagucaucccgaacauuggaagcagacccugggugcggggcguguccagccgcaucucuauuuacuggaccaucgucaaaccuggggacauccugcucauuaauuccacaggaaaccugaucgcccccagaggcuauuucaagauucggagcgggaagucuagcaucaugcgcuccgaugcuccuauuggaaaauguaauucugaaugcaucacccccaacggcagcaucccgaaugacaagccuuuucagaacguuaauagaauuaccuacggcgccuguccccgguaugugaaacagaacacacuuaagcuggcgacggggaugcgcaaugugccugagaaacaaaccagaggaaucuucggcgccauugcuggguuuaucgaaaacggaugggagggcauggucgacgggugguacggauuccggcaccaaaauuccgagggcacaggccaggccgcugaucucaagagcacccaggccgccauuaaccagaucaaugggaaacugaacagacuuaucgaaaagacaaaugagaaguuucaucagauugaaaaagaguucucugaaguggagggacgcauccaggaccuggagaaguauguugaagauaccaaaauugaccucugguccuacaacgcugagcugcugguggcgcucgaaaaccaacacacgaucgaucugacagacagcgagaugaauaaacuuuucgaacggaccaagaagcagcugagagagaacgccgaggauaugggcaaugggugcuuuaagauuuaucauaaaugugacaacgcuugcaucggaucuauucgcaauggcaccuacgaucacgacgucuaccgggaugaagcccucaacaauagauuccagaucaaggggguggagcugaaauccggcuauaaggacuggauccuuuggauuagcuuugccaucuccugcuuccugcucuguguugugcugcugggauuuauuaugugggcuugccagaaaggcaacauccgcuguaauauuugcaucuga

SEQ ID NO: 184618 - RNA, 1701 nt, Artificial Sequence; identical to SEQ ID NO: 183096
  derived and/or modified sequence opt5 from hemagglutinin__InfluenzaA__ABO33047

SEQ ID NO: 184619 - RNA, 1701 nt, Artificial Sequence; identical to SEQ ID NO: 183674
  derived and/or modified sequence opt5 from hemagglutinin__InfluenzaA__ABO33058

SEQ ID NO: 184620 - RNA, 1701 nt, Artificial Sequence
  derived and/or modified sequence opt5 from hemagglutinin__InfluenzaA__ABO33069
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcagaauuugcgacucuccgcaccggauccuugaugggaagaacuguacccugaucgacgcccuccugggagauccccauugcgacggcuuccagaaugagaaaugggaucuguuugucgaacgcagcaaggccuucuccaacuguuauccuuacgacgugcccgauuaugcuucucucagaagccugguugccuccagcgggacgcuugaguuuauuaaugaaggauucaacuggaccggcgugacacagaauggcgggucuuacgcuugcaaacggggaccugacaacuccuuuuucagccgccugaauuggcucuaugagucugaguccaaguaccccguccugaacgugaccaugccuaauaacgauaacuuugacaagcuguauaucuggggcguucaccauccgagcacagauaaagaacaaaccaaucuguacgugcaggccucugggagagucacgguguccacaaagaaaagccagcagaccauuauccccaacgugggaucccggccuuggguccgcggccucucuagcagaauuuccaucuacuggacaauuguuaagcccggggacauccugcugaucaauagcaacggaaaucucauugcgccucggggcuauuucaaaauccgcaccggcaagucuuccauuaugagaagcgacgcccccaucgggaccuguucuagcgagugcauuacaccgaacggauccaucccuaaugauaagcccuuucaaaacgugaauaaaaucacguacggcgcuuguccuaaguaugugaaacagaacacccugaaacuugccacagggaugcggaauguccccgaaaagcagacccgcggaauuuucggcgcuaucgccggguuuauugagaacggaugggagggcaugguggacggcugguacggguucagacaccaaaauucugaaggaacaggccaggcggccgaucuuaagagcacccaggcugccaucgaccagauuaacgggaaacucaaucggguuaucgagaagacgaacgaaaaguuccaccaaaucgagaaagaauuuuccgagguggagggacgcauucaggaucuggaaaaguauaucgaggacacaaaaauugaucuuuggagcuacaacgcugaacugcucgucgcccuggagaaucagcauaccaucgaccugaccgauucuaagaugaacaaacucuucgaaaagacaagacggcagcugagagagaaugccgaggacaugggcaacgggugcuuuaagauuuaucacaaaugugauaaugcuugcaucggcuccauucgcaacggaaccuacgaccaugacguguaccgggaugaagcgcuuaauaacagauuccaaaucaagggcguugagcugaaaagcggguauaaggacuggauccucuggauuucuuuugccaucuccugcuuccugcuuugugugguccugcucggauuuauuaugugggcuugccagaaaggcaauauccgcuguaacauuugcaucuga

SEQ ID NO: 184621 - RNA, 1701 nt, Artificial Sequence; identical to SEQ ID NO: 183945
  derived and/or modified sequence opt5 from hemagglutinin__InfluenzaA__ABO37988

SEQ ID NO: 184622 - RNA, 1701 nt, Artificial Sequence
  derived and/or modified sequence opt5 from hemagglutinin__InfluenzaA__ABO38010
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugcgggagcaacuuucuagcguuuccagcuuugaacgcuucgagaucuuucccaaggagucuuccuggccuaaucauaccgugacaaagggagucaccgcuagcugcucucacaacggcaaauccagcuucuacaagaaucugcucuggcugacagagaaaaacggccuuuaucccaaucugucuaaguccuacgugaacaauaaagaaaaggaaguucucgugcuguggggaguccaucacccuagcaacauuggggaucagagagccaucuaccacaccgagaacgcguauguguccguggucucuagccauuacucccggcgcuuuacgccggaaaucgccaagagacccaaaguucgggaccaggagggccgcauuaauuauuacuggacacugcucgagccuggggauaccaucauuuucgaagcuaacggaaaucugaucgcccccugguaugcuuuugcccuuagcagaggcguggggucuggaauuaucacauccaacgcgagcaugggcgacugugaugccaagugccagaccccucaaggcgcuauuaauucuagccugcccuuccagaacgugcacccggucaccaucggggaguguccuaaauacgugcgguccacaaagcuccgcaugguuacgggacugagaaauauccccucuauucagagccggggccuuuuuggggccaucgcuggauucauugaaggcggguggaccggaaugaucgacggcugguauggcuaccaucaccagaacgagcaaggguccggauacgccgccgauaaaaagagcacacagaaugcuauugacggcaucaccaacaaagucaauucugugaucgaaaagaugaacacacaguuuaccgcgguggggaaggaguucaauaaacuggagcgcagaauggaaaaccucaauaagaaaguugaugacggauuccuggacauuuggacguauaacgccgagcugcucgugcugcuugaaaacgagcggacacuggauuuucacgacuccaaugucaagaaccucuacgaaaaagugaagaaucagcugaagaacaaugcuaaagagaucggcaacgggugcuucgaguuuuaucauaaguguaauaacgaaugcauggagagcgucaaaaauggcaccuacgauuauccuaaguacucugaagaguccaaacuuaagcgcgagaagauugacggagugaaacuggaaagcaugggcguuuaucaaauccucgccauuuacuccaccguggccucuagccugguccugcucgugucccugggggcuaucucuuucuggaugugcagcaacggaucccuucaguguagaaucugcauuuga

SEQ ID NO: 184623 - RNA, 1698 nt, Artificial Sequence
  derived and/or modified sequence opt5 from hemagglutinin__InfluenzaA__ABO38021
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucccgaaagaguccuggucuuacauuguugaaacccccaauccugagaacggcacguguuaucccggguacuuugccgacuaugaggaacugagagagcaacucagcuccgugucuagcuucgaacgguuugagaucuucccuaaggaguccagcuggcccaaucauaccgucacaggagugucugcuuccugcagccacaacggcaagucuuccuuuuaccgcaaucugcuuuggcugaccggcaaaaacgggcucuauccuaaucugagcaagucuuacgccaacaauaaagaaaaggagguucuggugcucuggggaguccaucacccgcccaacaucggcgaucagagagcucuguaccacacagaaaacgccuauguguccguggucagcucccauuacucucggcgcuucauuccugagauggcgaaaagacccaagguucgggaccaggaagggcgcaucaauuauuacuggacccuucuggagccuggagauacgauuaucuuugaggccaacggcaaucucauugcucccugguaugccuucgcucugagcagaggguuuggauccggcaucauuacaagcaacgccccgaugggcgaaugugacgcgaagugccagaccccucaaggggccaucaauucuucccuucccuuccagaacgugcacccugugacaaucggagagugucccaaauacguccggagcgcuaagcugcgcauggugaccggccucagaaauauucccucuauccagagccgggggcuguuuggagccauugcuggcuucaucgaagggggauggaccggcaugguugauggcugguauggguaccaucaccagaacgagcaaggauccggcuacgccgccgaccagaaaucuacacagaaugcuauuaacgggaucacgaauaaggugaacagcgucaucgaaaagaugaauacccaguuuacagcggugggaaaagaguucaacaaacuggagcgcagaauggaaaaucucaacaagaagguugaugacggcuuccuggauauuuggaccuauaacgccgagcuucuggugcuccuggaaaaugagcggacacuugacuuucacgacuccaacgucaaaaaucuguacgaaaaggugaaaagccaacucaagaacaaugcuaaagagaucgggaacggcugcuucgaguuuuaucauaaguguaauaacgaaugcauggagucugucaagaauggaaccuacgauuauccuaaauacuccgaagagagcaagcugaaccgcgagaaaauugacggcgugaagcuggaaucuauggggguuuaucagauccucgccauuuacuccacgguggccagcucccugguccuucuggugucucucggagcuaucagcuucuggaugugcuccaauggcucucugcaguguagaaucugcauuuga

SEQ ID NO: 184624 - RNA, 1698 nt, Artificial Sequence
  derived and/or modified sequence opt5 from hemagglutinin__InfluenzaA__ABO38032
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccggaccccgagaauggcacguguuauccuggguacuuugccgauuaugaggaacugagagagcaacucuccucugucagcuccuucgaacgguuugagaucuuccccaaggagagcucuuggccuaaccauaccgugacaggaguuuccgccagcugcucucacaauggcaaguccagcuuuuaccgcaaccugcuuuggcugaccggcaaaaaugggcucuaucccaaccugucuaaguccuacgcuaauaacaaagaaaaggaggugcugguccucuggggagugcaucacccuccgaauaucggcgaccagagagcccuguaccacacagaaaacgcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuagauaugcuuucgcccugucccggggguuuggaagcggcaucauuaccucuaaugcucccauggaugaaugugacgccaagugccagacaccgaaaggcgcgaucaacuccagccuuccuuuccaaaaugugcaccccgucaccaucggggaguguccuaaguacgugcgcucugccaaacugagaaugguuaccggacuccggaacauucccagcauccagucccgcggccuguuuggggcuauugccggauucaucgaaggcggguggacaggaaugguggauggcugguauggcuaccaucaccagaaugagcaggggucuggauacgcugccgaccaaaagagcacgcagaacgccauuaauggcaucaccaacaaagucaauuccgugaucgaaaagaugaacacacaguuuaccgcuguugggaaagaguucaauaagcuggagagacggauggaaaaccucaauaagaaaguggaugacggauuccuggacauuuggacauauaacgcggagcuucugguccuccuggaaaacgagcgcacccuugauuuucacgacagcaaugugaagaaccuguacgaaaaagucaagucucagcucaaaaauaacgccaaggagaucggcaaugggugcuucgaguuuuaucauaaguguaacaaugaaugcauggaguccgugaaaaacggcacguacgauuaucccaaguacagcgaagagucuaaacugaauagagagaagauugacggaguuaaacuggaauccaugggcaucuaucaaauucucgcuaucuacagcacaguggccuccucucugguccuucuggugagccucggggccaucuccuucuggaugugcucuaacggaagccugcagugucggauuugcaucuga

SEQ ID NO: 184625 - RNA, 1698 nt, Artificial Sequence; identical to SEQ ID NO: 183824
  derived and/or modified sequence opt5 from hemagglutinin__InfluenzaA__ABO38043

SEQ ID NO: 184626 - RNA, 1701 nt, Artificial Sequence
  derived and/or modified sequence opt5 from hemagglutinin__InfluenzaA__ABO38054
augaaggccagacugcucgugcugcuuugcgcucuggccgcgaccgacgcugauacaaucuguauuggcuaccacgccaacaauagcacggacaccgucgauacaguucucgagaaaaacgugaccgugacacauuccgucaaucugcuugaagacucucacaacgggaagcugugccggcucaaaggaaucgccccgcugcagcugggcaaguguaauauugcuggguggauccucggaaacccugagugcgaaagccugcuuuccgagcgcucuuggagcuauauuguggaaacccccaauuccgagaacggcacauguuaccccggggauuucaucgacuaugaggaacugagagagcaacucucuagcguuuccagcuuugaacgguucgagaucuuuucuaaagaguccagcuggccuaagcauaauaccacgcgcggagugaccgccgcuugcucucacgccggcaaguccagcuucuacagaaaccugcuuuggcugacagaaaaagauggcucuuaucccaaucucaacaauuccuacgucaacaagaaagggaaggaggugcugguucuguggggagugcaucacccuagcaauauuaaagaccagcagacccucuaucagaaggaaaacgcguacgucuccguggugucuagcaacuacaaucggcgcuuuacacccgagaucgccgaaagaccuaagguccggggccaagcugggcgcaugaacuauuacuggacccugcuuaaaccgggagauacgauuauguucgaggccaauggcaaccugaucgcucccugguaugccuuugcgcucuccagaggguucggaagcggcauuaucacaucuaaugccuccaugcacgagugugacaccaagugccagacaccucagggcgcuauuaacagcucucugcccuuucagaauauccauccuguuaccaucggggaaugucccaaauacgugcggagcaccaaacuucgcauggugacaggacugagaaacauuccguccauccaaucucggggccucuucggggccauugcuggauuuaucgagggcggguggacgggaaugauugauggcugguauggcuaccaccaucagaaugaacaggggagcggauaugccgccgaccagaaguccacccaaaacgcuaucaauggcaucacaaacaaggucaauagcgugauugagaaaaugaacacccaguucacagcgguugggaaggaauuuaauaaccuggagaagcgcauggagaaccugaauaaaaagguggaugacggauuccucgacaucuggaccuacaacgccgaacugcuuguccugcucgagaaugaaagaacgcuggauuuccacgacucuaacgugaaaaaucuuuacgagaagguuaaaaaccagcugcggaauaacgcuaaggaaauuggcaaugggugcuuugaguucuaucacaaguguaacaaugagugcauggaauccgugaaaaacggcacauacgauuauccuaaguacagcgaggaaucuaaacucaauagagagaagaucgacggagucaaacuggaguccaugggcguguaucaaauucuggccaucuacagcaccgucgccuccucucucgugcugcuuguuagccugggggcuaucuccuuuuggaugugcucuaacggaagccuccagugucgcauuugcaucuga

SEQ ID NO: 184627 - RNA, 1701 nt, Artificial Sequence
  derived and/or modified sequence opt5 from hemagglutinin__InfluenzaA__ABO38065
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacaucacccggggaguuacggcuucuugcucccacaaaggcaagagcucuuuuuaucgcaaucuccuguggcuuaccgagaaaaacggcuccuacccuaaucugagcaaguccuaugugaacaauaaggaaaaagagguccucgugcuguggggaguucaucaccccucuaacauugaagaccagaagacaaucuacagaaaagagaaugccuacgugagcgucguguccagcaacuauaaccggcgcuucaccccugaaauugcgaagagaccgaaagugcgggggcaggagggccgcaucaauuacuauuggacacugcucgagcccggggauaccauuaucuuugaagccaacggaaaucugauugcuccuugguacgccuucgcucuuucuagaggcuuuggguccggaaucaucacgagcaacgccucuauggacgagugugauacaaagugccagacaccccaaggcgcgauuaauagcucccugccuuuccagaacguccaccccguuaccaucggcgaauguccgaaauaugugcggucuaccaagcuccgcauggugaccgggcugagaaauauuccuagcauccagucccggggacuuuuuggcgccauugcuggguucaucgagggaggcuggacagggaugaucgacggaugguacggcuaucaucaccagaacgaacaaggcagcggguacgccgcugaucagaagucuacgcagaaugccauuaacggaaucaccaauaaagucaacuccgugauugagaagaugaauacacaguuuaccgccguuggcaaagaguucaacaagcuggaaaaacgcauggagaaucucaacaagaagguggacgauggguuccuggacaucuggacauacaacgcugaacugcucguccugcuugagaaugaaagaacccuggacuuucaugauagcaacgugaaaaaucucuaugagaagguuaaaucucaacugaagaacaaugcgaaagagauuggaaacggcugcuucgaauuuuaccacaaguguaauaacgagugcauggaauccgugaagaaugggacguaugacuaccccaaauauagcgaggaguccaaacuuaaccgggaaaagaucgauggcgucaagcuggagucuaugggaguguaccagauccucgccauuuauagcacagucgcuuccucucuggugcugcucguuagccugggcgccaucuccuucuggaugugcagcaaugggucucuucaguguagaauuugcaucuga

SEQ ID NO: 184628 - RNA, 1701 nt, Artificial Sequence; identical to SEQ ID NO: 183267
  derived and/or modified sequence opt5 from hemagglutinin__InfluenzaA__ABO38076

SEQ ID NO: 184629 - RNA, 1701 nt, Artificial Sequence
  derived and/or modified sequence opt5 from hemagglutinin__InfluenzaA__ABO38087
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaucuggcaagagcuccaucaugcggucuaacgccccuauugggaaguguaauagcgaaugcaucacccccaacggauccaucccgaaugacaaaccuuuucagaacgugaaucgcauuacauacggcgccugucccagauaugugaagcagaacacgcuuaaacuggcgaccggcaugcggaaugucccugagaagcagacacgcgggaucuucggagccauugcuggcuuuaucgaaaacgggugggagggaaugguggacggcugguacggguucagacaucaaaauagcgagggaaccggccaggccgcugaucucaaaucuacacaggccgccauuaaccaaaucaauggcaagcugaaccggcuuaucgagaaaaccaaugaaaaguuucaccagauugaaaaggaguucuccgaaguugaggggagaauccaggaccuggagaaauauguggaagauacgaagauugaccucuggagcuacaacgcugagcugcuggucgcgcucgaaaaccagcauacaaucgaucugaccgacucugagaugaauaaacuuuucgaacgcacccggaagcaacugagagagaacgccgaggaugugggaaauggcugcuuuaaaauuuaucacaagugugacaacgcuugcaucggguccauucgcaauggaacauacgaucacgacguuuaccgggaugaagcccucaacaauagauuccagaucaagggcguggagcugaaaagcggguauaaggacuggauccuuuggauuuccuuugccaucucuugcuuccugcucugugucgugcugcugggcuuuauuaugugggcuugccagaaaggaaacauccgcuguaauauuugcaucuga

SEQ ID NO: 184630 - RNA, 1689 nt, Artificial Sequence
  derived and/or modified sequence opt5 from hemagglutinin__InfluenzaA__ABO38098
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgauaucgccaccagaccuaaagugaacggacaaggcggccggauggaguuuuccuggacacugcucgacaugugggauaccauuaacuucgaaagcaccgggaaucugaucgcucccgaguacggauuuaagaucucuaaacgcggcuccagcgggauuaugaagacagaaggaacgcuuggcaacugcgagaccaaaugucagacaccucugggggccaucaauaccacacuccccuuccauaacgugcacccgcugaccauuggagagugcccuaaguaugucaaauccgaaaaacuuguucuggcgacgggccucagaaaugugccccagaucgagucucggggccuguuuggggccauugcuggauucaucgaaggcggguggcagggaaugguggacggcugguacggguaucaucacagcaacgaucaaggcuccggauacgccgcugacaaggagagcacacagaaagccuuugacggcaucaccaauaaggucaacucugugauugaaaagaugaauacccaguucgaggcgguugggaaggaguuuuccaaccuggaacgcagacucgagaaucugaacaaaaagauggaagauggauuccuugacguguggacauauaaugccgagcugcucguccugauggaaaacgagcggacccuugauuuccacgacagcaaugugaagaaccuguacgauaaaguucgcaugcagcucagagacaacgugaaggagcugggcaauggguguuuugaguucuaucauaaaugcgaugacgaguguaugaacucugucaagaauggaacauacgauuacccuaaauaugaagaggagagcaagcugaaccggaaugaaaucaagggcgugaaacucuccucuaugggggucuaccaaauucuggcuaucuaugccacgguggcuggcagccuuucccuggccauuaugauggccggaaucagcuuuuggaugugcucuaacggcucccuccagugcagaaucuguauuuga

SEQ ID NO: 184631 - RNA, 1701 nt, Artificial Sequence
  derived and/or modified sequence opt5 from hemagglutinin__InfluenzaA__ABO38230
augaagaccaucauugcccugagcuacaucuucugccagguguuugcucaaaaccuccccggcaaugacaacuccacagccacgcugugucuugggcaccaugcggucccuaauggaacccugguuaaaacaauuaccaacgaucagaucgaggugacaaaugcuaccgaacucgugcagucuagcuccacaggcagaauuugcgacaacccgcaccggauccuggaugggaagaauuguacccuuaucgacgcccugcucggagauccccauugcgacggcuuccagaacgagaaaugggaucuguuugucgaacgcucuaaggccuucagcaauuguuauccuuacgacgugcccgauuaugcuucccugagaucucucguugccagcuccgggacgcuggaguuuuucaacgaaggauuuaauuggaccggcgugacacaaaacggcgggagcuacgcuugcaaacggggaccugacaauucuuucuuuucccgccuuaacuggcuguauaagagcgagucuaccuaccccguccucaaugugacaaugccuaacaacgauaauuucgacaagcuguauauuuggggcguucaccauccguccaccgauaaagagcagacgaaccuuuacgugcaggccagcgggagagucacagugucuaccaagcggucccagcaaacaaucauucccagcgugggaucccgcccuugggucagaggccugucuagccggaucuccauuuacuggaccaucguuaaacccggggacgugcuccugauuaauagcaacggaaaucugaucgcgccucgcggcuauuuuaagaucagaaccggcaaaucuuccauuaugcggagcgacgcccccaucgggacauguucuagcgaaugcauuacgccgaacggauccaucccuaaugauaagcccuuccagaacguggacaagauuaccuacggcgcuuguccuaaauaugucaagcagaauacacucaaacuggccaccgggaugcgcaacgugcccgagaagcagacaagaggaaucuuuggcgcuaucgccggguucauugaaaauggaugggagggcaugaucgauggcugguacggguuccggcaccaaaacucugagggaaccggccaggcggccgaccuuaaaagcacgcaggcugccauugaucaaaucaaugggaagcugaaccgcguuauugagaaaacaaaugaaaaguuucaccagaucgaaaaggaguucuccgaaguggagggaagaauccaggaccucgagaaauaugucgaagauaccaagauugaccuguggagcuacaacgcugagcuucugguggcccucgaaaaccagcauaccaucgaucugacagacucugagaugaauaaacuguuugaaaagacccggagacaacuccgcgagaacgccgaggauaugggcaaugggugcuucaaaauuuaucacaagugugacaacgcuugcaucggcuccauucggaauggaacauacgaccaugauguuuacagagacgaagcgcugaacaaucgcuuucagaucaagggcguggagcuuaaaagcggguauaaggauuggauucuguggaucucuuucgccaucuccugcuuucuccugugugucgugcuucugggauucauuaugugggcuugccagaaaggcaacauccgguguaauauuugcaucuga

SEQ ID NO: 184632 - RNA, 1701 nt, Artificial Sequence
  derived and/or modified sequence opt5 from hemagglutinin__InfluenzaA__ABO38241
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugaugggaaaaauuguacccugaucgacgcccuccugggagauccccauugcgacggcuuucagaacgagaagugggaucuguucgucgaacgcuccaaagccuuuucuaauuguuauccuuacgacgugcccgauuaugcuagccucagaucccugguugccagcucugggacgcuugaguucauuaacgaaggauuuaauuggaccggcgugacacaguccggcgggagcuauaccugcaagcggggaucugucaacuccuucuuuagccgccugaauuggcucuacgagucugaguccaaguacccugcucugaacgugacaaugcccaauaacggcaaauucgacaagcuguauaucuggggaguucaccauccuagcaccgauaaagaacaaacgaaucuguacgugagagccuccgggcgggucacagugucuaccaagcgcagccagcagacagugauuccgaacaucggccccagaccuuggguccgggggcucuccagccgcauuucuaucuacuggaccauuguuaaacccggagacauccugcugaucaacuccaccggcaaucucauugcgccuagaggcuauuuuaagauccggacagggaaguccucuauuaugcgcagcgaugcccccaucggaacguguuccucuggcugcauuaccccgaacgggagcaucccuaaugacaaacccuuccagaacgugaauaagaucacauacggagcuuguccuagauaugugaaacaaaacacccugaaacuugccacaggcaugcggaauguccccgagaaacagacccgcgggauuuuuggagcuaucgccggcuucauugaaaacggcugggaggggaugguggacggaugguacggcuuuagacaccagaauagcgaggggacgggacaggcggccgaucuuaagagcacacaagcugccaucgaccagauuaacggcaaacucaaucggcugaucgaaaagaccaacgagaaguuccaccagaucgaaaaagaguucucugaaguugaggggcgcauucaagaucuugagaaguauguggaagacaccaaaaucgaucugugguccuacaaugcugagcuccuggucgcccuggaaaaccagcauacaauugacaugaccgauagcgagaugaauaagcucuuugaaaagacaagaaagcagcugcgggagaacgccgaggacaugggcaacggaugcuucaagaucuaucacaaaugugauaaugcuugcauuggcucuaucagaaacgggacguacgaccaugauguguaccgcgacgaagcgcuuaauaaccgguuucagauuaagggaguugagcugaaauccggcuauaaggacuggauccucuggaucagcuucgccauuuccugcuuucugcuuugugugguccugcucggguucaucaugugggcuugccaaaaaggaaauauuagauguaacaucugcauuuga

SEQ ID NO: 184633 - RNA, 1701 nt, Artificial Sequence; identical to SEQ ID NO: 183306
  derived and/or modified sequence opt5 from hemagglutinin__InfluenzaA__ABO38252

SEQ ID NO: 184634 - RNA, 1689 nt, Artificial Sequence
  derived and/or modified sequence opt5 from hemagglutinin__InfluenzaA__ABO38296
auggugaucauuuaccugauccuccuguucaccgccgucagaggcgaccagauuugcaucggguaucacgcuaacaauagcacagagaagguugauacgauucuugaacggaacgugaccgugacacaugccaaagacauccuggagaagacccacaauggaaaacucuguaagcugaacggcauucccccucuugaacugggggauugcuccaucgcgggauggcuccugggcaauccggagugugaccgccugcucucuguccccgaauggagcuacaucauggagaaagagaacccuagagaugggcugugcuaucccggauccuuuaaugacuacgaagaacuuaagcauuuccugucuagcgugaagcacuuugaaaaaguuaagauucucccuaaagaucgguggacacaacauaccacaaccggcggcucccgcgcuugugccgugucugggaaccccagcuucuuuagaaauauggucuggcugacgaagaaaggauccaacuauccuguggccaagggcagcuacaauaacaccucuggggagcagaugcuuaucauuuggggaguucaccacccgaaugacgagacagaacagcggacccuguaucagaacgugggcacauacgucuccguggggaccagcacgcucaauaagcgcucuacacccgauaucgcuaccagaccuaaagugaacggacugggcggccggauggaguucuccuggacacugcucgacaugugggauaccauuaacuuugaaagcaccgggaaucugaucgcccccgaguacggauucaagaucucuaaacgcggcuccagcgggauuaugaagacagaaggaacgcuuggcaacugcgagaccaaaugucaaacaccucugggggcuaucaauaccacacuccccuuucauaacguccacccgcugaccauuggagagugcccuaaguauguuaaauccgaaaaacuugugcuggccacgggccucagaaaugugccccagaucgagucucggggccuguucggggcgauugccggauuuaucgaaggcggguggcagggaauggucgacggcugguacggguaucaucacagcaacgaucagggcuccggauacgcugccgacaaggagagcacacaaaaggcuuucgacggcaucaccaauaaggugaacucuguuauugagaaaaugaauacccaguuugaggccguggggaaggaguucuccaaccuggaacgcagacucgagaaucugaacaaaaagauggaagauggauuccuugacgucuggacauauaaugcggagcugcucgugcugauggaaaacgagcggacccuugauuuucacgacagcaauguuaagaaccuguacgauaaagugcgcaugcagcucagagacaacgccaaggagcugggcaauggguguuucgaauuuuaucauaaaugcgaugacgaguguaugaacucugucaagaauggaacauacuacuauccuaaauacgaagaggagagcaagcugaaccggaaugaaaucaagggcgugaaacucuccucuaugggggucuaucagauucuggcuaucuacgccacgguggcuggcagccuuucccuggccauuaugauggccggaaucagcuucuggaugugcucuaacggcucccuccaaugcagaaucuguauuuga

SEQ ID NO: 184635 - RNA, 1698 nt, Artificial Sequence; identical to SEQ ID NO: 183894
  derived and/or modified sequence opt5 from hemagglutinin__InfluenzaA__ABO38318

SEQ ID NO: 184636 - RNA, 1698 nt, Artificial Sequence; identical to SEQ ID NO: 183824
  derived and/or modified sequence opt5 from hemagglutinin__InfluenzaA__ABO38329

SEQ ID NO: 184637 - RNA, 1701 nt, Artificial Sequence
  derived and/or modified sequence opt5 from hemagglutinin__InfluenzaA__ABO38351
augaaggccagacugcucgugcugcuuugcgcucuggccgcgaccgacgcugauacaaucuguauuggcuaccacgccaacaauagcacggacaccgucgauacaguucucgagaaaaacgugaccgugacacauuccgucaaucugcuugaagacucucacaacgggaagcugugccggcucaaaggaaucgcuccccugcagcugggcaaguguaauauugccggguggcuccugggaaacccugagugcgauccgcuucugcccgcccgcagcugguccuauaucguggaaaccccuaauucugagaacggcauuuguuaccccggggcuuucaucgacuaugaagaacucagagagcaacugagcuccguuucuagcuuugaacgguucgagaucuuuccuaaagaauccagcuggcccaaucauaacacaaauauuggagugaccgccgcgugcucucacgccggcaaguccagcuucuaccgcaaccuucuguggcucacgaagaaaggcgggucuuauccuaagcugaaaaauuccuacgucaacaagaaaggaaaggaggugcugguucucuggggcauccaucacccgagcaauucuaaggaucagcagacccuguaucagaacgagaacgcuuacguguccgucgugagcuccaauuacaacagacgguuuacacccgaaauugccgagcgcccugaagugagagaccaagcugggcggaugaauuauuacuggacccuucuggagcccggagauacaaucauguucgaagccaacggcaaucucgucgcgccuugguaugccuuugcucugucucgcggguucggaagcggcauuaucaccuccaacgccagcaugcacgaguguaauacgaaaugccagacaccccagggcgcuauuaacucuucccuuccguuucagaauauccauccuguuaccaucggggagugucccaaguacgugagaagcgccaaacugcggauggugacaggacuccgcaacauuccuucuauccaaagcagaggccuguucggggccauugcuggauuuaucgaaggcggguggaccggaaugauugacggcugguauggcuaccaccaucagaaugagcagggguccggauaugcggccgaucagaagucuacccaaaacgcuaucaauggcaucacaaacaaagucaauagcgugauugaaaagaugaacacgcaguucaccgccguugggaaagaguuuaacaaucuggaaaagcggauggagaaccucaauaagaaaguggacgauggauuccuggacaucuggacauacaacgccgagcuucugguccuccuggaaaaugagcgcacccuugacuuccacgauuccaacgugaagaaucuguacgaaaaaguuaagagccagcucaaaaacaaugcuaaggagauuggcaacgggugcuuugaguucuaucacaagugugacaaugagugcauggagucugugagaaacggcacauacgauuaucccaaauacuccgaagagagcaagcugaaucgggagaaaaucgacggagucaagcuggaaucuaugggcguguaucaaauucucgccaucuacuccaccgucgcgagcucccuggugcuucugguuucucucggggcuaucagcuuuuggaugugcuccaacggaucucugcaguguagaauuugcaucuga

SEQ ID NO: 184638 - RNA, 1701 nt, Artificial Sequence
  derived and/or modified sequence opt5 from hemagglutinin__InfluenzaA__ABO38362
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuggugagcaagaaguccuggucuuauauugccgagaccccgaacagcgaaaauggcacauguuaccccggguauuucgccgauuacgaggagcuucgggaacaacuguccagcguuucuuccuuugagcgcuucgaaaucuuuccuaaagagagcucuuggcccaagcauaacgugaccagaggagucacggcuuccugcagccacaaaggcaagucuuccuucuaucggaaucuccuguggcuuaccgagaaaaacggcagcuacccuaaucuguccaagucuuaugugaacaauaaggaaaaagagguucucgugcuguggggaguccaucaccccagcaacaucgaaaaucagaagacaauuuaccgcaaagagaacgccuacguguccguggucagcucucacuauaacagacgguuuaccccugaaaucgcgaagcgcccgaaaguuagagaccaggaggggcggauuaauuacuauuggacacugcucgagcccggcgauaccaucauuuucgaagccaacgggaaucugaucgcuccuugguacgccuuugcucuuucccgcggauucggcagcgggauuaucacgucuaacgccagcaucgacgagugugaugcgaagugccagacaccccaaggagccauuaauuccucucugccuuuucagaacgugcaucccgugaccaucggcgaauguccgaaauaugucagaagcacaaagcuccggauggugaccggccugcgcaauauuccuuccauccagagcagagggcuuuucggagcuauugccggcuuuaucgaagggggauggaccggcaugaucgacgggugguacggauaucaccaucagaacgaacaaggcucuggcuacgcugccgaucagaaguccacacagaaugccauuaacgggaucacgaauaaaguuaacagcgugauugagaagaugaauacccaguucacagcugucggaaaagaguuuaacaagcuggaaaaacggauggagaaucucaacaagaagguggacgauggcuuccuggacaucuggaccuacaacgcggaacugcucguucugcuugagaaugaacgcacacuggacuuccacgauucuaacgugaaaaaucucuaugagaaggucaaaucccaacugaagaacaaugccaaagagauugggaacggaugcuuugaguucuaccacaaguguaauaacgagugcauggaaagcgugaagaauggcaccuaugacuaccccaaauauuccgaggagucuaaacuuaacagagaaaagaucgauggggucaagcuggagagcaugggcguguaccagauccucgcuauuuauuccacgguugccucuagccuggugcugcucgucucccugggagccaucagcuuuuggaugugcucuaauggcucccuucagugucggauuugcaucuga

SEQ ID NO: 184639 - RNA, 1698 nt, Artificial Sequence
  derived and/or modified sequence opt5 from hemagglutinin__InfluenzaA__ABO38373
augaaggccagacugcucgugcugcuuugcgcucuggccgcgaccgacgcugauacaaucuguauuggcuaccacgccaacaauagcacggacaccgucgauacaguucucgagaaaaacgugaccgugacacauuccgucaaucugcuugaagacucucacaacgggaagcugugccggcucaaaggaaucgccccgcugcagcugggcaaguguaauauugcuggguggauccucggaaacccugagugcgaaagccugcuuuccgagcgcucuuggagcuauauuguggaaacccccaauuccgagaacggcacauguuaccccggggauuucaucgacuaugaggaacugagagagcaacucucuagcguuuccagcuuugaacgguucgagaucuuuucuaaagaguccagcuggccuaagcauaccacgggaggcgugaccgccgcuugcucucacgccggcaaguccagcuucuaccgcaaucugcuuuggcugacagaaaaagaugggucuuaucccaaccucaauaacuccuacgucaauaagaaaggaaaggaggugcugguucuguggggcgugcaucacccuagcaacauuaaagaccagcagacccucuaucagaaggaaaaugcguacgucuccguggugucuagcaacuacaacagacgguuuacacccgagaucgccgaacgcccuaaggucagagggcaagcuggacggauuaauuauuacuggacccugcuuaaaccgggcgauacgaucauguucgaggccaacgggaaucugauugcucccugguaugccuuugcgcucucccgcggauucggcagcggcaucauuacaucuaacgccuccaugcacgagugugacaccaagugccagacaccucagggggcuaucaauagcucucugcccuuucagaacauccauccuguuaccauuggagaaugucccaaauacgugagaagcaccaagcuccggauggugacaggccugcgcaauaucccguccauucaaucuagagggcuuuucggagccaucgcuggcuuuauugaagggggauggacgggcaugaucgauggcugguauggguaccaccaucagaacgagcagggaagcggcuaugccgccgaccagaaauccacccaaaaugcuaucaacgggauuacaaauaaggucaacagcgugaucgagaaaaugaauacccaguucacagcgguuggaaaggaauuuaacaaucuggagaagcggauggagaaccugaacaaaaagguggaugacggcuuccucgacauuuggaccuacaaugccgaacugcuuguccugcucgagaacgaacgcacgcuggauuuccacgacucuaaugugaaaaaccuuuacgagaagguuaaaaaucagcugagaaacaaugcuaaggaaaucgggaacggcugcuuugaguucuaucacaaguguaauaacgagugcauggaauccgugaaaaauggaacauacgauuauccuaaguacagcgaggaaucuaaacucaaccgggagaagauugacggcgucaaacuggaguccauggggguguaucaaauccuggccaucuacagcaccgccgcuuccucucucguccugcuugugagccugggagccauuuccuuuuggaugugcucuaauggcagccuccaguguagaaucugcauuuga

SEQ ID NO: 184640 - RNA, 1701 nt, Artificial Sequence
  derived and/or modified sequence opt5 from hemagglutinin__InfluenzaA__ABO38384
augaaggccagacugcucgugcugcuuugcgcucuggccgcggcugacgccgauaccaucuguauuggcuaccacgccaacaauagcacagacacggucgauaccguucucgagaaaaacgugacagugacccauuccgucaaucugcuugaagacucucacaacgggaagcugugccggcucaaaggaaucccuccccugcagcugggcaaguguaauauugcuggguggcuccugggaaacccggagugcgauagccuucugcccgcccgcuccuggucuuauaucguggaaacaccuaauagcgagaacggcgcuuguuaccccggggacuucauuaauuaugaggagcucagagagcaacuguccucuguuagcuccuuugaacgguucgagaucuuuccuaaagaaagcucuuggcccaagcauaacaccacaaagggagugaccgccgcgugcucccacgccggcaaaagcucuuucuaccgcaaucuucuguggcucacgaagaaagaggauuccuauccuaagcugaaaaacagcuacgucaauaagaagggcaaagaggugcugguucucuggggagugcaucacccgucuuccagcaaggaacagcagacccuguaucagaacgagaaugcuuacgucuccguggugucuagcaacuacaacagacgguuuacacccgaaaucgccgagcgcccuaaagucagagaccaaaccgggcggaugaauuauuacuggacacuucuggaacccggcgauaccauuaucuucgaggcuaacgggaaucucauugccccuugguaugcguuugcccugucccgcggauucggcagcgggaucauuacgucuaacgcuuccaugcacgaguguaauacaaagugccagacaccccagggagccaucaacagcucucuuccguuucagaauauucauccuguuaccaucggcgaaugucccaaauacgugagaagcgcuaagcugcggauggugaccggccuccgcaacaucccuuccauucaaucuagagggcuguucggagccaucgccggcuuuauugaagggggauggaccggcaugaucgacgggugguauggauaccaccaucagaaugaacagggcagcggcuaugcugcggaucagaaauccacacaaaacgccauuaaugggaucacgaacaaggucaauagcgugaucgagaagaugaacacccaguucacagcuguuggaaaagaauuuaauaaccuggagaagcggauggagaaccucaauaaaaagguggacgauggcuuccuggacauuuggaccuacaacgccgaacuucugguccuccuggagaaugaacgcacacuugacuuccacgauucuaacgugaaaaaucuguacgagaagguuaagucccagcucaaaaacaaugccaaggaaaucgggaacggaugcuuugaguucuaucacaaaugugacaaugagugcauggaaagcgugagaaacggcaccuacgauuaucccaaguacucugaggaauccaaacugaaucgggagaagauugacggggucaagcuggagagcaugggcguguaucaaauccucgcuauuuacuccacggucgccucuagccuggugcuucugguuucccucggagcgaucucuuuuuggaugugcagcaacggcucccugcaguguagaaucugcauuuga

SEQ ID NO: 184641 - RNA, 1701 nt, Artificial Sequence
  derived and/or modified sequence opt5 from hemagglutinin__InfluenzaA__ABO38395
augaaggccaagcugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaaaggagugacagcuucuugcucccacaagggcagaagcucuuucuaucggaaccugcucuggcugaccaaaaagaauggcuccuacccuaaccuuagcaaauccuaugucaauaacaaggagaaggaagugcugguucucuggggagugcaucaccccucuaauaucggggaccagcgcgccauuuaccacacagagaacgcguacgucagcgugguguccagccauuauaacagacgguuuaccccugaaaucgccaaacgcccgaaggucagagaucaggagggccggauuaauuacuauuggacgcugcuggaacccggggacacaaucauuuucgaggcuaacggaaaucucaucgccccuugguacgcuuuugcccugucucgcggcuucggguccggaauuaucaccagcaacgcgucuauggaugagugugacgccaaaugccagacaccccaaggcgcuaucaauagcucccuuccuuuucagaacguucaccccgugaccauuggcgaauguccgaaguaugugagaucuaccaaacugcggauggucacagggcuccgcaauaucccuagcauucaguccagaggacuguucggcgccaucgcuggguuuauugagggaggcuggacggggaugaucgauggaugguacggcuaucaucaccagaacgaacaaggcagcggguacgccgccgaccagaagucuacccagaaugcuaucaacggaauuacaaauaaagugaacuccguuaucgagaagaugaauacccaguucacagcggugggcaaggaguucaacaaacuugaacggcgcauggagaaucugaacaagaaagucgaugacggguuucucgacauuuggaccuacaacgccgaacugcuggugcuccuggagaaugaaagaacgcuugauuuccacgacagcaacguuaagaaucuguaugagaaagugaagucucaacucaagaacaaugcuaaagaaaucggaaacggcugcuuugaguucuaccauaaguguaauaacgagugcauggaauccgucaaaaaugggacauaugauuaccccaaguauagcgaggaauccaaacugaaccgggagaagauugacggcgugaaacuugagucuaugggagucuaccagauccuggccaucuauagcaccguggccuccucucucguucugcuggugagccucggcgcuauuuccuuuuggaugugcagcaaugggucucugcaguguagaaucugcauuuga

SEQ ID NO: 184642 - RNA, 1701 nt, Artificial Sequence
  derived and/or modified sequence opt5 from hemagglutinin__InfluenzaA__ABO38406
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaucauaacguuaccaaaggagugacggcuucuugcucccacaagggcaaaagcucuuuuuaucgcaaucuccuguggcuuaccgagaagaagggcuccuacccuaaccugagcaaauccuaugucaauaacaaggaaaaagaggugcucguucugugggggauccaucaccccucuaauauugaagaccagaagacaaucuacagaaaagagaacgccuacgugagcgucguguccagccacuauaaccggcgcuucaccccugaaauugcgaagagaccgaaagugcgggaucaggagggacgcaucaauuacuauuggacacugcucgagcccggcgacaccauuaucuuugaagccaacgggaaucugauugcuccuugguacgccuucgcucuuucuagaggauuuggcuccgggaucaucacgagcaacgccucuauggaugagugugacgcgaagugccagacaccccggggagccauuaauagcucccugccuuuccaaaacguccaucccguuaccaucggcgaauguccgaaguaugugcgcucuacaaaacucagaauggugaccggccugcggaauauuccuagcauccagucccgcgggcuuuuuggagcuauugccggcuucaucgaagggggauggaccggcaugaucgaugggugguacggauaucaccaucagaacgaacagggcagcggcuacgcugccgaccaaaagucuacacaguccgccauuaaugggaucacgaacaaagucaauagcauuaucgagaagaugaacacccaguuuacagcugugggaaaagaguucaauaagcuggaaaagagaauggagaaccucaauaaaaagguugaugacggcuuccuggacauuuggaccuacaacgcggaacugcucgugcugcuugagaacgaacggacacuggauuuucacgacucuaaugucaaaaaccucuaugagaaggugaaaucccagcugaagaauaacgccaaggagaucgggaauggaugcuucgaauuuuaccacaaauguaacaaugagugcauggaaagcguuaagaacggcaccuaugauuaccccaaauauuccgaggagucuaaacuuaaucgcgagaagaucgacggggugaagcuggagagcaugggcgucuaccaaauucucgcuaucuauuccacgguggccucuagccugguccugcucgugucccugggagccauuagcuucuggaugugcucuaacggcucccuucaguguagaaucugcauuuga

SEQ ID NO: 184643 - RNA, 1701 nt, Artificial Sequence
  derived and/or modified sequence opt5 from hemagglutinin__InfluenzaA__ABO38417
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcccgacaggaagaauuugcgacucuccccaucagauccuggauggcgagaauuguacccucaucgacgcccugcugggggauccucacugcgacggauuucagaacaaagaaugggaucucuucguggagcggucuacggccuauagcaauuguuaccccuaugacguuccugauuacgcuucccugcgcucucuuguggccagcuccggcacccuggaauuuaacaaugagagcuucaacuggacaggggucgcucagaauggaaccucuuccgccugcaagagacggagcauuaaauccuuuuucucccgccucaacuggcugcaucaacuuaaguauaaguaccccgcgcugaaugugacaaugccuaacaaugagaaauuugacaagcucuauaucuggggcguucaccacccgagcaccgauucugaccagauuucccuguacgcccaggcuagcggcagagugacggucuccacaaaacggucucagcaaaccgugauccccaacauugggagccgcccuugggugagaggagucuccagccggaucucuauuuacuggacaaucguuaagcccggcgauauccugcucauuaacuccaccgggaaucugaucgccccucgcggauauuucaaaauuagaagcggcaagucuagcaucaugcgguccaacacccccauugggaaguguaauucugaaugcaucacaccgaacggaagcaucccuaaugacaaacccuuucagaacgugaaucgcauuacguacggcgcuuguccuagauaugugaagcagaacacccuuaaacuggccacaggcaugcggaauguccccgagaagcagacccgcgggaucuucggagcgauugccggcuuuaucgaaaacgggugggagggaaugguggacggcugguacggguucagacaucaaaauuccgagggaacaggccaggcugccgaucucaaaagcacccaggcugccauuaaccaaaucaauggcaagcugaaccggcuuaucgagaaaacgaaugaaaaguuucaccagauugaaaaggaguucucugaaguugaggggagaauccaggaccuggagaaauauguggaagauacaaagauugaccucugguccuacaacgccgagcugcuggucgcucucgaaaaccagcauaccaucgaucugaccgacagcgagaugaauaaacuuuucgaacgcacacggaagcaacugagagagaacgcggaggauaugggaaauggcugcuuuaaaauuuaucacaagugugacaacgccugcaucgggucuauucgcaauggaaccuacgaucacgacguguaccgggaugaagcucucaacaauagauuccagaucaagggcguugagcugaaauccggguauaaggacuggauccuuuggauuagcuuugccaucuccugcuuccugcucugugugguccugcugggcuuuauuaugugggccugccagaaaggaaacauccgcuguaauauuugcaucuga

SEQ ID NO: 184644 - RNA, 1689 nt, Artificial Sequence
  derived and/or modified sequence opt5 from hemagglutinin__InfluenzaA__ABO38712
auggccaucauuuacuucauccugcucuuuaccgcugugagaggcgaccagauuugcaucggguaucacgccaacaauagcacagagaaggucgauacgauucuggaacggaacguuaccgugacacaugcgaaagacauccuugagaagacccacaauggaaaacuguguaagcucaacggcauucccccucuggaacuuggggauugcuccaucgcuggauggcugcucggcaauccggagugugaccgccugcugagagugcccgaauggucuuacaucauggagaaagagaacccucgguauagccucugcuaccccggguccuucaaugauuaugaggaacugaagcaucuucugucuagcgucaagcacuuugaaaaagugcgcauucucccuaaggacggauggacacaacauaccacauccggcggcucuaaagccugugccguuagcgggaaguccagcuucuuuagaaacaugguguggcugaccaaaaagggacccaauuacccugucgcuaagcggucuuauaacaauacguccggcgagcagaugcuuaucauuuggggagugcaccacccgaaagaugaggccgaacagcgcgcucuguaccagaagguugggaccuacgugagcgccucuacauccacccucaacaaaagaagcacacccgagaucgcggcccggccugaagucaauggccuggggucucgcauggaguucuccuggacccugcucgacgugugggauacgauuaacuuugaaagcacaggaaaucugguggcucccgaguauggcuucaagaucuccaaaagaggcucuagcgggaucaugaagaccgagggaacacuuggcaacugcgaaaccaaaugucaaaccccucugggggccauuaacacaacgcuccccuuucauaauguccacccgcugaccaucggagagugcccuaaguacguuaaguccgaaaaacuugugcuggcuacaggccuccggaacgugccccagauugagagccgcgggcuguucggagccaucgcgggcuuuauugaaggcggguggcagggaauggucgacggcugguauggguaccaucacucuaaugaucagggauccggcuaugccgcugacaaggagagcacccaaaaagccuucgauagaaucacaaacaagguuaauucugugaucgagaaaaugaacacccaguuugaagcuguggggaaggaguucagcaaucuggaaaagcggcucgagaaccugaauaaaaagauggaagacggcuuccuugacgucuggacguacaacgccgagcugcucgugcugauggagaaugaacgcacacuugauuuucacgacuccaacguuaaaaaucuguauaacaaggugagaaugcagcuccgggauaaugucaaagagcugggaaacggcuguuucgaauuuuaccauaagugcgacgaugaguguaugucuagcgugaagaacgggaccuacgacuauccuaaauacgaggaagaguccaagcugaaaagaaaugaaauuaagggagucaaacucagcucuaugggcguguaucagauccuggccauuuacgcuaccguugcggggucccuuagccuggccaucaugauugcuggaaucucucucuggaugugcuccaacggcagccugcaaugccgcaucuguauuuga

SEQ ID NO: 184645 - RNA, 1689 nt, Artificial Sequence
  derived and/or modified sequence opt5 from hemagglutinin__InfluenzaA__ABO38723
auggccaucauuuacuucauccugcucuuuaccgcugugagaggcgaccagauuugcaucggguaucacgccaacaauagcacagagaaggucgauacgauucuggaacggaacguuaccgugacacaugcgaaagacauccuugagaagacccacaauggaaaacuguguaagcucaacggcauucccccucuggaacuuggggauugcuccaucgcuggauggcugcucggcaauccggagugugaccgccugcugagagugcccgaauggucuuacaucauggagaaagagaacccucgguauagccucugcuaccccggguccuucaaugauuaugaggaacugaagcaucuucugucuagcgucaagcacuuugaaaaagugcgcauucucccuaaggacggauggacacaacauaccacauccggcggcucuaaagccugugccguuagcgggaaguccagcuucuuuagaaacaugguguggcugaccaaaaagggacccaauuacccugucgcuaagcggucuuauaacaauacguccggcgagcagaugcuuaucauuuggggagugcaccacccgaacgaugaggccgaacagcgcgcucuguaccagaaaguugggaccuacgugagcgccucuacauccacccucaauaagagaagcacacccgagaucgcggcccggccugaagucaacggccuggggucucgcauggaguucuccuggacccugcucgacgugugggauacgauuaauuuugaaagcacaggaaaccugguggcucccgaguauggcuucaaaaucuccaagagaggcucuagcgggaucaugaaaaccgagggaacacuuggcaacugcgaaaccaagugucaaaccccucugggggccauuaauacaacgcuccccuuucauaacguccacccgcugaccaucggagagugcccuaaauacguuaaguccgaaaaacuugugcuggcuacaggccuccggaaugugccccagauugagagccgcgggcuguucggagccaucgcgggcuuuauugaaggcggguggcagggaauggucgacggcugguauggguaccaucacucuaacgaucagggauccggcuaugccgcugacaaggagagcacccaaaaggccuucgauagaaucacaaauaaagugaacucuguuaucgagaagaugaauacccaguuugaagcuguggggaaagaguucagcaaccuggaaaagcggcucggcaaucugaacaagaaaauggaggacggauuccuugacgucuggacguacaaugccgaacugcucgugcugauggagaacgagcgcacacuugauuuucacgacuccaauguuaagaaccuguauaauaaagugagaaugcagcuccgggauaacgucaaggaacugggcaacggguguuucgaguuuuaccauaaaugcgacgaugaauguaugucuagcgugaagaauggaaccuacgacuauccuaaguacgaggaggaauccaaacugaagagaaacgagauuaaaggcgucaagcucagcucuauggggguguaucagauccuggccauuuacgcuaccguugcgggaucccuuagccuggccaucaugauugcuggcaucucucucuggaugugcuccaaugggagccugcaaugccgcaucuguauuuga

SEQ ID NO: 184646 - RNA, 1698 nt, Artificial Sequence
  derived and/or modified sequence opt5 from hemagglutinin__InfluenzaA__ABO44046
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaagaugaacuccgucaucgaaaagaugaauacacaguuuaccgcuguggggaaagaguucaacaaacuggagagacggauggaaaaucucaacaagaagguugacgauggauuccuggacauuuggacauauaacgcggagcuucuggugcuccuggaaaaugagcgcacccuugacuuucacgauagcaacgucaaaaaucuguacgaaaaggugaaaucucaacucaagaacaaugccaaagagaucggcaacgggugcuucgaguuuuaucauaaguguaauaacgaaugcauggaguccgucaagaauggcacguacgacuaucccaaauacagcgaagagucuaagcugaacagagagaaaauugauggagugaagcuggaauccaugggcguuuaucagauccucgcuauuuacagcacaguggccuccucucugguccuucuggugagccucggggccaucuccuucuggaugugcucuaauggaagccugcagugucggaucugcauuuga

SEQ ID NO: 184647 - RNA, 1689 nt, Artificial Sequence
  derived and/or modified sequence opt5 from hemagglutinin__InfluenzaA__ABO44057
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaggaacuuaagcaucugcucucuagcgucaagcacuucgaaaaagugaagauucugccuaaagacggauggacacaacaugagaccgauggcggcuccaaggccugugccguuucugggaaagcuagcuuuuuccgcaacaugguguggcuuacaaagagaggacccaauuaccaggucgccaagcgguccuauaacaauaccagcggcgagcagaugcugaucauuuggggagugcaccacccuaaagacgaagcugagcagcgcgcccucuaccaaaagguugggacguacgugucugcguccaccagcacacugaacaaaagaucuaccccggaaaucgccgcucggcccgaggucaauggccuggaaucccgcauggaguuuagcuggacacuccuggaugugugggacaccauuaacuucgagucuacggggaaucuuguggccccugaauauggauuuaagaucuccaaaagaggcagcuccggcaucaugaagacagaggggacccugggaaacugcgaaacaaaaugucagacaccccucggcgcuauuaacaccacccugccuuuccauaauguccacccccuuacgaucggggagugcccgaaguacguuaagucugaaaaacuggugcucgccaccggacugcggaacgugccucagauugagagccgcggccuguuuggggcgaucgccggauucauugagggcggcuggcaggggauggucgauggaugguauggcuaccaucacuccaaugaccaagggagcggauaugcugccgauaaggaaucuacacagaaggcuuuugacagaaucaccaacaaaguuaauuccgugaucgagaaaaugaacauucaguucgaagccgugggcaaggaguuuagcaaucucgaaaagcggcuggagaaccuuaauaaaaagauggaggacggguuccuggaugucuggacauacaacgccgaacuccuggugcuuauggagaaugaacgcacccuggacuuccacgauucuaacguuaaaaaucucuaugacaaggugagaaugcagcugcgggauaacgucaaagagcugggcaauggauguuuugaguucuaccauaagugcgacgaugaauguaugaacagcgugaagaacggcacguacgacuaucccaaauacgaggaagaguccaagcucaaaagaaaugaaaucaagggggucaaacugucuagcaugggaguguaucaaauucuugcuaucuacgcgacaguugccggcucccugagccucgcuauuaugaucgccgggaucucuuuuuggaugugcuccaacggaagccugcagugccgcguguguauuuga

SEQ ID NO: 184648 - RNA, 1701 nt, Artificial Sequence; identical to SEQ ID NO: 183280
  derived and/or modified sequence opt5 from hemagglutinin__InfluenzaA__ABO44079

SEQ ID NO: 184649 - RNA, 1689 nt, Artificial Sequence
  derived and/or modified sequence opt5 from hemagglutinin__InfluenzaA__ABO44090
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccauugcuggauggcuccugggcaauccggagugugaccgccugcucagagugcccgaauggucuuacaucauggagaaagagaacccucgggaugggcugugcuaucccggaucuuuuaaugacuacgaggagcuuaagcaucugcucuccucugucaagcacuucgaaaaagugaagauucugccuaaagaucgcuggacacaacauaccacaaccggcggcagcagagccugugccguuuccgggaaccccagcuuuuuccggaauaugaucuggcuuacgaagaaaggaagcaacuauccuguggcuaagggcuccuacaauaacaccagcggggagcagaugcugauuaucuggggaguccaccacccgaaugacgagacagaacagcgcacccucuaucagaacgugggcacauacguuucuguggucaccuccacgcugaauaagagaagcacacccaaaauugccacccggccuaaggugaacgggcugggaggccgcauggaguuuucuuggacacuccuggauaugugggacaccaucaacuucgaauccaccggcaaucuuaucgcucccgaguacggguuuaaaauuagcaagagaggaucuuccggcaucaugaaaacagaagggacgcuggagaacugcgagaccaagugucaaacaccucucggagccauuaauaccacacugcccuuccauaacgugcacccgcuuaccaucggcgaaugcccuaaauaugucaagagcgagaagcugguucucgcgacggggcugcggaaugugccccagauugaaucccgcggacuguuuggcgccaucgcuggcuucaucgaagggggauggcagggcaugguggaugggugguacggauaucaucacucuaacgaccagggcagcggguacgccgcugauaaagaauccacacaaagagccuuugacggcauuaccaauaaggucaacagcgugaucgagaaaaugaauacccaguucgaggcgguuggaaaggaauuuucuaaccucgagcggcgccuggaaaaucuuaacaaaaagauggaggacggccugcucgauguguggacauauaaugccgaacugcuuguccugauggagaacgagagaauccucgacuuccacgauuccaaugugaagaaccuguacgacaaaguucggaugcagcugagagauaacgugaaggaacucgggaauggauguuucgaguuuuaucauaaaugcgacgaugaauguaugaacagcgucaagaauggcaccuacgacuacccuaaauaugaggaggaaucuaagcugaaccgcaaugagaucaagggggugaaacuuagcuccaugggagucuaccagauucuggcuaucuaugccacaguggcuggcucucucagccuggccaucaugauggccgggauuuccuucuggaugugcagcaacggcucucugcaaugccggaucuguauuuga

SEQ ID NO: 184650 - RNA, 1689 nt, Artificial Sequence
  derived and/or modified sequence opt5 from hemagglutinin__InfluenzaA__ABO44101
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagacggauggacacaacauaagaccgauggcggcuccaaagccugugccguuucugggaagcccagcuuuuuccgcaacaugguguggcuuacaaagaaaggaccuaauuacccggucgcuaagagauccuauaacaauaccagcggcgagcagaugcugaucauuuggggagugcaccaccccaacgacgaggccgaacagcgggcucucuaccagaaaguugggacguacgugucugccuccaccagcacacugaauaagcgcucuaccccugagaucgcggccagacccgaagucuccggccuggggagccggauggaguuuucuuggacacuccuggaugugugggacaccauuuccuucgaaagcacgggaaaccuuguggcuccugaguauggcuuuaaaaucuccaagcgcggcucuagcgggaucaugaaaacagagggaacccugggcaauugcgaaacaaagugucaaacaccccucggggccauuaacaccacccugccguuccauaacguccacccucuuacgaucggagagugccccaaguacguuaaauccgaaaagcuggugcucgcuaccggccugagaaaugugccucagauugagagccgggggcuguuuggagccaucgcgggcuucauugaaggcggguggcagggaauggucgauggcugguauggguaccaucacucuaacgaccagggauccggcuaugccgcugauaaagagagcacacaaaaggccuuugaccgcaucaccaauaaagugaacucuguuaucgagaagaugaauacacaguucgaagcuguggggaaggaguuuagcaaccucgagaaaagacuggagaaucuuaacaagaaaauggaagacggcuuccuggaugucuggaccuacaaugccgagcuccuggugcuuauggagaacgaacggacgcuggacuuccacgauuccaauguuaagaaccucuaugacaaagugcgcaugcagcugagagauaaugucaaggagcugggaaacggcuguuuugaguucuaccauaagugcgacgaugaauguaugaacucugugaaaaaugggacauacgacuaucccaaguacgaggaagagagcaaacucaagcggaacgaaauuaaaggagucaagcuguccagcaugggcguguaucagauccuugccauuuacgcuaccguugcggggucucugucccucgccaucaugauugcuggaaucagcuuuuggaugugcucuaauggcucccugcaaugcagaaucuguauuuga

SEQ ID NO: 184651 - RNA, 1701 nt, Artificial Sequence
  derived and/or modified sequence opt5 from hemagglutinin__InfluenzaA__ABO44123
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaaaggagugacagcuucuugcucccacaagggcaaaagcucuuucuauagaaaccugcucuggcugaccaagaaaaauggcuccuacccuaaccuuagcaaguccuaugucaauaacaaggagaaagaagugcugguucucuggggagugcaucaccccucuaauaucggggaccagcgggccauuuaccacacagagaacgcguacgucagcgugguguccagccauuauaaccgcagauuuaccccugaaaucgccaagcggccgaaaguccgcgaucaggagggcagaauuaauuacuauuggacgcugcuggaacccggggacacaaucauuuucgaggcuaacggaaaucucaucgccccuugguacgcuuuugcccugucucggggcuucggguccggaauuaucaccagcaacgcgucuauggaugagugugacgccaagugccagacaccccaaggcgcuaucaauagcucccuuccuuuucagaacguucaccccgugaccauuggcgaauguccgaaauaugugcgcucuaccaagcugagaauggucacagggcuccggaauaucccuagcauucagucccgcggacuguucggcgccaucgcuggguuuauugagggaggcuggacggggaugaucgauggaugguacggcuaucaucaccagaacgaacaaggcagcggguacgccgccgaccagaaaucuacccagaaugcuaucaacggaauuacaaauaaggugaacuccguuaucgagaagaugaauacccaguucacagcggugggcaaagaguucaacaaacuugaaagacggauggagaaucugaacaagaaggucgaugacggguuucucgacauuuggaccuacaacgccgaacugcuggugcuccuggagaaugaacgcacgcuugauuuccacgacagcaacguuaaaaaucuguaugagaaggugaagucucaacucaaaaacaaugcuaaggaaaucggaaacggcugcuuugaguucuaccauaaauguaauaacgagugcauggaauccgucaagaaugggacauaugauuaccccaaauauagcgaggaauccaagcugaacagagagaagauugacggcgugaaacuugagucuaugggagucuaccagauccuggccaucuauagcaccguggccuccucucucguucugcuggugagccucggcgcuauuuccuuuuggaugugcagcaaugggucucugcagugucggaucugcauuuga

SEQ ID NO: 184652 - RNA, 1701 nt, Artificial Sequence
  derived and/or modified sequence opt5 from hemagglutinin__InfluenzaA__ABO44134
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucgcggagagaccgaagguccgggggcaggccggccgcauuaauuacuauuggacacugcucgagcccggggauaccaucauuuuugaagcuaacggaaaucugaucgccccuuggcacgcuuucgcccuuucuagaggcuuuggguccggaauuaucacgagcaacgcgucuauggacgagugugauacaaaaugccagacaccccaaggcgccaucaauagcucccugccuuuccagaacauucaucccguuaccaucggcgaauguccgaaguacgugcggucuaccaaacuccgcauggugaccgggcugagaaauauuccuagcauccagucccggggacuuuuuggcgcuauugccggguucaucgagggaggcuggacagggaugaucgacggaugguauggcuaccaccaucagaacgaacaaggcagcggguaugcugccgaucagaagucuacgcagaaugccauuaacggaaucaccaauaaggucaacuccgugauugagaaaaugaauacacaguuuaccgcuguuggcaaggaguucaacaaacuggaaaagcgcauggagaaucucaacaaaaagguggacgauggguuccuggacaucuggacauacaacgcggaacugcucguccugcuugagaaugaaagaacccuggacuuucacgauagcaacgugaagaaucucuacgagaaaguuaagucucaacugaaaaacaaugccaaggagauuggaaacggcugcuucgaauuuuaucacaaauguaauaacgagugcauggaauccgugaagaaugggacguacgacuaucccaaguacagcgaggaguccaaacuuaaccgggaaaagaucgauggcgucaaacuggagucuaugggaguguaucagauccucgcuauuuacagcacagucgccuccucucuggugcugcucguuagccugggcgccaucuccuucuggaugugcagcaaugggucucuucaguguagaauuugcaucuga

SEQ ID NO: 184653 - RNA, 1701 nt, Artificial Sequence
  derived and/or modified sequence opt5 from hemagglutinin__InfluenzaA__ABO52071
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgggaucugcgacuccccgcaccagauccuugauggagagaacuguacccugauugacgcccuccugggcgauccccagugcgacggguuucagaauaaaaagugggaucuguucgucgaaagaucuaaagccuauagcaacuguuacccuuaugacgugcccgauuacgcuucccuccggucucugguugccagcuccggaacgcuugaguuuaauaacgaaucuuucaauuggaccggcgugacacagaacggcaccucuuccgcuugcaagcgcagaagcaauaacagcuuuuucucccggcugaauuggcucacacaucugaaguuuaaauauccugcccuuaacgucaccaugcccaacaaugagaaguucgacaaacuguacaucuggggagugcaccauccuagcacggauaacgaccagauuucucucuaugcgcaggccuccgggcgcaucacaguuagcaccaagagaucccaacagacagugauuccgaauaucggcucucggccccgcgucagagauauuccuagccggaucuccaucuacuggaccauugugaaacccggggacauccugcugauuaacagcaccggaaaucucaucgcuccucgcggcuacuuuaagauuagaucugggaaguccagcaucaugcggucugacgcccccaucggaaaauguaacagcgagugcauuacaccgaauggcuccaucccuaacgauaagcccuuccagaaugugaaccgcauuacguauggcgcuuguccuagauacgucaaacagaauacccugaagcuggccacagggaugcggaacguucccgaaaaacaaacccgcggaaucuuuggcgcgauugccggguucaucgagaauggaugggaaggcaugguggacgggugguauggauuuagacaccagaacucugagggcaucggccaggcugccgaucuuaagagcacacaagcugccauuaaucagaucaacgggaaacucaaccggcugauuggaaagaccaaugagaaguuccaccagaucgaaaaagaguucuccgaaguggagggccgcauucaggaccuugaaaaguacgucgaggauacgaaaaucgaccuguggagcuauaacgccgagcuccugguggcucuggaaaaucaacauacaauugaucucaccgacucugagaugaacaagcuguuugaaagaaccaaaaagcagcuucgggagaaugcggaagauauggggaacggaugcuucaagaucuaccacaaaugugacaaugccugcaucggcuccauuagaaacgggacauaugaucaugacguuuaccgcgacgaggcucugaauaaccgguuucagaucaagggcguggagcucaaaagcggauacaaggauuggauucuguggaucucuuucgccauuuccugcuuucuucugugugucgcccuccugggcuucaucaugugggcuugccagaaagggaauaucagauguaacauuugcaucuga

SEQ ID NO: 184654 - RNA, 1701 nt, Artificial Sequence
  derived and/or modified sequence opt5 from hemagglutinin__InfluenzaA__ABO52225
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaccccgaaucccgagaacggcacguguuauccuggguacuucgccgacuaugaggaacugaaggagcaacuuucuagcguuuccagcuuugaacgguucgagaucuuucccaaggagucuuccuggccuaaucauaccgugacaaaaggagucaccgcuagcugcucucacaacggcaaguccagcuucuacaaaaaucugcucuggcugacagaaaagaacggccuuuaucccaaucugucuaaauccuacgugaacaauaaggagaaggaaguucucgugcuguggggaguccaucacccuagcaacauuggggaucagcgcgccaucuaccacaccgagaacgcguauguguccguggucucuagccauuacuccagacgguuuacgccggaaaucgccaaacgccccaagguuagagaccaggagggccggauuaauuauuacuggacacugcucgagccuggggauaccaucauuuucgaagcuaacggaaaucugaucgcccccugguaugcuuuugcccuuagccgcggcuucgggucuggaauuaucacauccaacgcgagcaugggcgagugugacgccaaaugccagaccccucaaggcgcuauuaauucuagccugcccuuucagaacgugcacccggugaccaucggggaauguccuaaguacgucagauccacaaaacuccggauggugacgggacugcgcaauauccccucuauucagagcagaggccuuuucggggccaucgcuggauuuauugagggcggguggaccggaaugaucgauggcugguauggcuaccaucaccagaacgaacaaggguccggauacgccgccgacaagaaaagcacacagaaugcuauugauggcaucaccaacaagguuaauucugugaucgagaagaugaacacacaguucaccgcggucgggaaagaguucaauaagcuggaacggcgcauggagaaccucaauaaaaagguggacgauggauuucuggacauuuggacguauaacgccgaacugcucguucugcuugagaacgaaagaacacuggacuuccacgauuccaaugugaaaaaccucuacgagaaggucaagaaucagcugaaaaacaaugcuaaggagaucggcaacgggugcuuugaguucuaucauaaauguaaugacgaaugcauggaaagcgugaagaacggcaccuacgauuauccuaaauacucugaggaguccaaacuuaagcgggaaaagauugacggagucaagcuggagagcaugggcguguaucaaauccucgccauuuacuccaccguugccucuagccuggugcugcucgucucccugggggcuaucucuuuuuggaugugcagcaauggaucccuucagugucgcaucugcauuuga

SEQ ID NO: 184655 - RNA, 1689 nt, Artificial Sequence
  derived and/or modified sequence opt5 from hemagglutinin__InfluenzaA__ABO52236
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggaacuuaagcauuuccugucuagcgucaagcacuuugaaaaagugaagauucucccuaaagaucgguggacacaacauaccacaaccggcggcucccgcgccugugccguuucugggaaccccagcuucuuuagaaauaugguguggcugacgaagaaaggauccaacuauccugucgcuaagggcagcuacaauaacaccucuggggagcagaugcuuaucauuuggggagugcaccacccgaaugacgagacagaacagcggacccuguaucagaacguuggcacauacguguccgucgggaccagcacgcucaauaagcgcucuacacccgauaucgccaccagaccuaaagugaacggacugggcggccggauggaguucuccuggacacugcucgacaugugggauaccauuaacuuugaaagcaccgggaaucugaucgcucccgaguacggauucaagaucucuaaacgcggcuccagcgggauuaugaagacagaaggaacgcuuggcaacugcgagaccaaaugucaaacaccucugggggccaucaauaccacacuccccuuucauaacgugcacccgcugaccauuggagagugcccuaaguaugucaaauccgaaaaacuuguucuggcgacgggccucagaaaugugccccagaucgagucucggggccuguucggggccauugcuggauuuaucgaaggcggguggcagggaaugguggacggcugguacggguaucaucacagcaacgaucagggcuccggauacgccgcugacaaggagagcacacaaaaagccuucgacggcaucaccaauaaggucaacucugugauugaaaagaugaauacccaguuugaggcgguugggaaggaguucuccaaccuggaacgcagacucgagaaucugaacaaaaagauggaagauggauuccuugacguguggacauauaaugccgagcugcucguccugauggaaaacgagcggacccuugauuuucacgacagcaaugugaagaaccuguacgauaaaguucgcaugcagcucagagacaacgcuaaggagcugggcaauggguguuucgaauuuuaucauaaaugcgaugacgaguguaugaacucugugaagaauggaacauacuacuauccuaaauacgaagaggagagcaagcugaaccggaaugaaaucaagggcgucaaacucuccucuauggggguguaucagauucuggccaucuacgcuacggucgccggcagccuuucccuggccauuaugauggcuggaaucagcuucuggaugugcucuaacggcucccuccaaugcagaaucuguauuuga

SEQ ID NO: 184656 - RNA, 1689 nt, Artificial Sequence
  derived and/or modified sequence opt5 from hemagglutinin__InfluenzaA__ABO52247
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagacggauggacacaacauaagaccgauggcggcuccaaagccugugccguuucugggaagcccagcuuuuuccgcaacaugguguggcuuacaaagaaaggaccuaauuacccggucgcuaagagauccuauaacaauaccagcggcgagcagaugcugaucauuuggggagugcaccaccccaacgacgaggccgaacagcgggcucucuaccagaaaguugggacguacgugucugccuccaccagcacacugaauaagcgcucuaccccugagaucgcggccagacccgaagucuccggccuggggagccggauggaguuuucuuggacacuccuggaugugugggacaccauuuccuucgaaagcacgggaaaccuuguggcuccugaguauggcuuuaaaaucuccaagcgcggcucuagcgggaucaugaaaacagagggaacccugggcaauugcgaaacaaagugucaaacaccccucggggccauuaacaccacccugccguuccauaacguccacccucuuacgaucggagagugccccaaguacguuaaauccgaaaagcuggugcucgcuaccggcccuagaaaugugccccagauugagagccgggggcuguuuggagccaucgcgggcuucauugaaggcggguggcagggaauggucgauggcugguauggguaccaucacucuaacgaccagggauccggcuaugccgcugauaaagagagcacacaaaaggccuuugaccgcaucaccaauaaagugaacucuguuaucgagaagaugaauacacaguucgaagcuguggggaaggaguuuagcaaccuggagaaaagacucgagaaucugaacaagaaaauggaagacggcuuccuugaugucuggaccuacaaugccgagcugcucgugcugauggagaacgaacggacgcuugacuuccacgauuccaauguuaagaaccuguaugacaaagugcgcaugcagcucagagauaaugucaaggagcugggaaacggcuguuuugaguucuaccauaagugcgacgaugaauguaugaacucugugaaaaaugggacauacgacuaucccaaguacgaggaagagagcaaacugaagcggaacgaaauuaaaggagucaagcucuccagcaugggcguguaucagauccuggccauuuacgcuaccguugcggggucucuuucccuggccaucaugauugcuggaaucagcuuuuggaugugcucuaauggcucccuccaaugcagaaucuguauuuga

SEQ ID NO: 184657 - RNA, 1701 nt, Artificial Sequence
  derived and/or modified sequence opt5 from hemagglutinin__InfluenzaA__ABO52258
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagcucuuggcccaagcauaacguuaccagaggagugacggcuuccugcagccacaaaggcaaguguucuuuuuaucggaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuaccgcaaagagaaugccuacgucagcgugguguccagccacuauaacagacgguucaccccugaaaucgcgaagcgcccgaaagucagagaucaggaggggcggauuaacuacuauuggacacugcucgagcccggcgacaccaucauuuuugaagccaaugggaaccugaucgcuccuugguacgccuucgcucuuucucgcggauuuggcuccgggauuaucacgagcaaugccucuauggaugagugcgacgcgaagugucagacaccccaaggagccaucaacagcucccugccuuuccagaauguucaucccgugaccauuggcgaaugcccgaaauaugugagaucuacaaagcuccggauggucaccggccugcgcaacaucccuagcauucaguccagagggcuuuuuggagcuaucgccggcuucauugaagggggauggaccggcaugaucgaugggugguacggauaucaccaucagaaugaacaaggcagcggcuacgcugccgaccagaagucuacacagaacgccaucaaugggauuacgaacaaaguuaauuccgugaucgagaagaugaacacccaguuuacagcugugggaaaagaguucaauaagcuggaaaaacggauggagaaccucaauaagaaggucgaugacggcuuccuggacauuuggaccuacaacgcggaacugcucgugcugcuugagaacgaacgcacacuggauuuucacgacagcaauguuaaaaaccucuaugagaaggugaaaucucaacugaagaauaacgccaaagagaucgggaauggauguuucgaauuuuaccacaagugcaacaaugagugcauggaauccgucaagaacggcaccuaugauuaccccaaauauagcgaggaguccaaacuuaauagagagaagauugacggggugaagcuggagucuaugggcgucuaccagauccucgcuaucuauagcacgguggccuccucucugguucugcucgugagccugggagccauuuccuucuggauguguagcaacggcucucuucagugccggaucuguauuuga

SEQ ID NO: 184658 - RNA, 1701 nt, Artificial Sequence
  derived and/or modified sequence opt5 from hemagglutinin__InfluenzaA__ABO52280
augaaggccagacugcucauccugcuuugcgcucugagcgccaccgacgcggauacaauuuguaucggcuaccacgcuaacaauuccacggacaccguggauacaguccucgagaaaaacguuaccgugacacauucugugaaucugcuugaagacagccacaacgggaagcugugccggcucaaaggaauugcuccccugcagcugggcaaguguaauaucgccggguggauucucggaaacccugagugcgaaucccugcuuucuaaucgcagcugguccuauaucgccgagaccccgaacucugaaaauggcaucuguuaccccggggauuucgccgacuaugaggagcugagagaacaacucagcuccgucagcucuuuugagcgguucgaaauuuuuccuaaagaguccagcuggcccaagcauaacaucacacgcggagugaccguugcuugcucucacgccaagaaauccagcuucuacaagaaucugcuuuggcugacggaggcgaacggccucuauccuucucuguccaaaagcuacgugaaugauagagaaaaggagguccuggugcucuggggcguucaucaccccuccaacauugaagaccagcggacccuguaucgcaaagagaaugccuacgugucugucgugagcuccaacuacaacagacgguuuacaccugaaaucgcugagcgcccgaaggugagagggcagcccggacggaugaauuauuacuggacccuucuggagccuggcgauaagauuaucuucgaagccaacgggaaucucauugcucccugguaugccuuugcgcugagccgcggaccuggcucugggaucaucacauccaacgccagcauggacgagugugauaccaaaugccagacgccccaaggagcuauuaauucuagccuuccguuccagaacauccacccugucacaauuggcgaaugucccaaguacguuagauccaccaaacugcggauggugacaggccuccgcaauaucccuucuauucagagcagagggcuguuuggagccaucgcuggcuucaucgaagggggauggaccggcaugguggacgggugguauggauaccaucaccagaacgagcaaggcuccggcuaugccgccgaucaaaagagcacccagaaugcuauuaacgggaucacaaauaaagucaacucugugauugagaagaugaauacgcaguuuaccgcgguuggaaaagaguucaacaagcuggaaaagcggauggagaaucucaacaaaaagguggacgacggcuuucuggauaucuggacauacaacgccgaacuucugguccuccuggagaaugaaagaacccuugacuuccaugauuccaacgugaaaaaucuguacgagaagguuaaaaaccagcuccgcaauaacgcuaaggagauugggaauggaugcuucgaauuuuaucacaagugugacaacgagugcauggaaagcgugaaaaauggcacauacgauuaucccaaguacucugaggaguccaaacugaaccgggccaagaucgacggggucaaacuggaaagcaugggcguguaucagauccucgccauuuacuccaccgucgcuucuagccuggugcuucugguuucccucggagccaucucuuucuggaugugcagcaauggcucccugcaguguagaauuugcaucuga

SEQ ID NO: 184659 - RNA, 1689 nt, Artificial Sequence
  derived and/or modified sequence opt5 from hemagglutinin__InfluenzaA__ABO52302
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacuggggaauugcuccaucgcuggauggcuccugggcaacccggagugugaucgccugcucucugugcccgaauggagcuacaucauggagaaagagaauccuagagacgggcugugcuaucccggauccuuuaacgauuacgaagaacuuaagcaucugcucucuagcgucaagcacuucgaaaaagugaagauucugccuaaagaccgguggacacaacauaccacaaccggcggcucccgcgccugugccguuucugggaaucccagcuuuuucagaaacaugguguggcuuacgaagaaaggauccaauuauccugucgcuaagggcagcuacaacaauaccucuggggagcagaugcugaucauuuggggagugcaccacccgaacgaugagacagaacagcggacccucuaucagaauguuggcacauacguguccgucgggaccagcacgcugaacaagcgcucuacacccgacaucgccaccagaccuaaagugaacggacugggcggccggauggaguuuuccuggacacuccuggauaugugggacaccauuaauuucgaaagcaccgggaaccuuaucgcucccgaguacggauuuaagaucucuaaacgcggcuccagcgggauuaugaagacagaaggaacgcugggcaauugcgagaccaaaugucaaacaccucucggggccaucaacaccacacugcccuuccauaaugugcacccgcuuaccauuggagagugcccuaaguaugucaaauccgaaaagcugguucucgcgacgggccugagaaacgugccccagaucgagucucggggccuguuuggggccauugcuggauucaucgaaggcggguggcagggaaugguggauggcugguacggguaucaucacagcaaugaccagggcuccggauacgccgcugauaaggagagcacacaaaaagccuuugacggcaucaccaacaaggucaauucugugauugagaaaaugaacacccaguucgaggcgguugggaaggaguuuuccaaucucgaacgcagacuggagaaccuuaauaaaaagauggaagacggauuccuggauguguggacauauaacgccgagcuccugguccuuauggaaaaugagcggacccuggacuuccacgauagcaacgugaagaaccucuacgacaaaguucgcaugcagcugagagauaaugugaaggagcugggcaacggguguuuugaguucuaucauaaaugcgacgaugaauguaugaacucugucaagaauggaacauacgacuacccuaaauaugaagaggagagcaagcucaaucggaacgaaaucaagggcgugaaacuguccucuauggggauuuaccagauccuugcuauuuaugccacggucgcuggcagccugucccucgccaucaugauggccggaaucagcuuuuggaugugcucuaauggcucccugcaaugcagaauuuguaucuga

SEQ ID NO: 184660 - RNA, 1701 nt, Artificial Sequence
  derived and/or modified sequence opt5 from hemagglutinin__InfluenzaA__ABO52313
augaagaccaucauugcccugagcuacaucuucugccucguguuugcucagaaccugcccggcaaugacaacuccacagccacgcuuugucuggggcaccaugcggucccuaauggaacccucguuaaaacaauuaccaacgaucaaaucgaggugacaaaugcuaccgaacuggugcagucuagcuccacaggcaagauuugcaacaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcaacgcuugcaaaagaggaccugauucuggcuuuuucucccggcugaauuggcucuacaagagcgggucuaccuaucccguccugaacgugacaaugccuaacaaugacaacuuugauaaacuuuacauuuggggaguucaccauccguccaccgaccaagagcagacgaaucuguaugugcaggccagcggccgcgucacagugucuaccaagagaucccagcaaacaaucauucccaacguggggagccggccuuggguccgcggacucuccucuagaaucagcauuuacuggaccaucguuaagcccggcgauauccuggugauuaauuccaacggcaaucugaucgcgccucgggggcacuucaaaaugcgcaccggaaagagcucuauuaugagauccgacgcccccaucggcacauguagcucugagugcauuacgccgaacgggagcaucccuaaugacaaacccuuucagaacgugaauaagaucaccuacggagcuuguccuaaguaugucaaacagaacacacucaagcuggccaccggcaugcggaaugugcccgaaaaacagacacgcgggauuuucggagcuaucgccggcuuuauugagaacggcugggaagggaugaucgauggaugguacggcuucagacaccgcaauuccgaggggaccggacaagcggccgaccuuaagucuacgcaggcugccauugaucagaucaacggcaaacugaaccggguuaucgagaagacaaaugaaaaauuccaucaaauugagaaggaauuuagcgagguggaagggagaauccaggaccucgagaaguaugucgaggauaccaaaauugaccugugguccuacaacgcugaacuucugguggcccucgagaaucagcacaccaucgaucugacagacagcgaaaugaacaagcuguucgagaaaacccggagacagcuccgcgaaaaugccgaggauaugggcaacggaugcuuuaagauuuaucauaaaugugacaaugcuugcaucggcucuauucggaacgggacauacgaucacgacguuuauagagacgaggcgcugaauaaccgcuuccaaaucaagggaguggaacuuaaguccggcuacaaagauuggauccuguggauuagcuuugccaucucuugcuuccuccugugugucgugcuucugggguuuauuaugugggcuugccagaagggaaauauccgguguaacauuugcaucuga

SEQ ID NO: 184661 - RNA, 1701 nt, Artificial Sequence
  derived and/or modified sequence opt5 from hemagglutinin__InfluenzaA__ABO52335
augaagaccaucauugcccugagcuacaucuucugccucgugcugggccaggacuuucccagaaacgauaauuccacagcuacgcuuugucuggggcaccaugccgucccuaacggaacccucguuaaaacaauuaccaaugaccaaaucgaggugacaaacgcgaccgaacuggugcagucuagcuccacaggcaagauuugcaauaacccgcaccggauccuugaugggaucgacuguacccugauugaugcucuccugggagacccccauugcgauggcuuccagaaugagacgugggaccuguuugucgaacgcucuaaagccuucagcaacuguuauccuuacgaugugcccgacuaugccucccucagaucucugguugcuagcuccgggacccuugaguuuaucaaugaaggauucacauggaccggcgugacacagaacggcgggagcaaugccugcaagcggggaccugauucuggcuuuuucucccgccugaacuggcucuacaaaagcgggaauaccuaucccguccugaacgugacgaugccuaauaacgacaacuuugauaaacuuuacauuuggggaguucaccauccgucuacagaccaagaccagaccucccuguaugugcaggcuagcggcagagucacagugucuaccaagcggucccagcaaaccgugauccccaauauugggccucgccccugggucagaggacucagcucccggaucucuauuuacuggacaaucguuaagccuggcgauauccugcugauuaacagcaauggcaaccucaucgcccccagaggguacuucaagaugagaacgggaaaauccagcauuaugcggucugacgcgccgaucggcaccuguauuuccgagugcaucacaccuaaugggagcauccccaacgauaagccuuuucagaaugugaacaaaauuaccuauggagccugucccaaguacgugaagcagaauacacugaaacuugcuaccggcaugcgcaacguccccgagaagcagacgagagggaucuucggagccauugcuggcuuuaucgaaaauggcugggaggggaugauugacggaugguauggcuuccggcaccaaaacucugaagggacaggacaggccgcggaucugaaaagcacccaggccgcuaucgaccaaaucaauggcaagcucaaccgcgugauugagaaaaccaaugagaaguuccaccagaucgaaaaagaguuuuccgaaguugaggggcgcauucaggaucuggaaaaguacguggaggacacaaagaucgaucuuuggucuuauaacgccgagcugcucgucgcucuggaaaaccagcauaccauugaccugacagauagcgagaugaauaaacucuucgaaaagacgcggagacaacugcgcgagaacgccgaagacaugggcaauggaugcuuuaaaaucuaccaccggugugacaacgccugcauuggcuccaucagaaaugggaccuaugaucaugacguguaccgcgaugaggcucuuaacaaucgguuccagaucaagggaguugagcugaaaagcggcuacaaggacuggauucucuggaucucuuuugcgauuuccugcuuccugcuuugugugguccugcucggguuuaucaugugggccugccagaagggaaacauuagauguaauaucugcaucuga

SEQ ID NO: 184662 - RNA, 1701 nt, Artificial Sequence
  derived and/or modified sequence opt5 from hemagglutinin__InfluenzaA__ABO52346
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcgauuguuauccuuacgacgugcccgauuaugcuucccuccgcucucugguugccagcuccgggacgcuugaguuuaucaacgaaggauucaauuggaccggcgugacacagaacggcgggagcucugcuugcaaaagaggaccugacaauggcuuuuucucccggcugaacuggcucuacaagagcgggucuaccuaucccguccaaaaugugacaaugccuaacaaugauaacuccgacaagcuguacauuuggggaguucaccauccgagcaccgacaaagagcagacggaucuuuaugugcaggccucuggcaaggucacaguguccaccaaacgcagccagcaaacagugauccccaacgucggguccagaccuuggguucggggacugucuagccgcguguccauuuacuggaccaucgugaagcccggcgacauucucgucaucaauagcaacggcaaucugaucgcgccuagaggguacuuuaaaaugcggaccggaaagucuuccauuaugcgcagcgaugcccccaucggcacauguucuagcgagugcauuacgccgaacggguccaucccuaaugacaagcccuuccagaacgugaauaaaauuaccuauggagcuuguccuaaguacguuaaacagaacacacugaagcucgccaccggcaugagaaaugugcccgaaaaacagacacgggggaucuuuggagcuaucgccggcuucauugagaacggcugggaagggaugaucgauggaugguauggcuuucgccaccaaaauucugaggggaccggacaggcggccgaccuuaagagcacgcaggcugccauugaucaaaucaacggcaaacugaauagagucauugagaagacaaacgaaaaguuccaccagaucgagaaagaguucuccgaaguggaagggcggauccaggaccuggagaaguacguugaggauaccaaaauugaccucuggagcuauaaugcugaacugcuuguggcccuggagaaccagcauaccaucgaucucacagacucugaaaugaacaagcuguuugagaaaacccgcagacaacugcgggaaaaugccgaggacaugggcaacggaugcuucaagauuuaccacaagugugauaaugcuugcaucggcuccauuagaaacgggacauaugaccaugaugucuaccgcgacgaggcgcucaauaaccgguuucagaucaaaggaguggaacuuaagagcggcuacaaagauuggauucuguggaucucuuucgccaucuccugcuuucugcucugugucgugcugcuuggguucauuaugugggcuugccagaagggaaauaucagauguaacauuugcaucuga

SEQ ID NO: 184663 - RNA, 1701 nt, Artificial Sequence
  derived and/or modified sequence opt5 from hemagglutinin__InfluenzaA__ABO52357
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuuucgagugcaucacaccgaaugggucuaucccuaacgacaaacccuuucagaaugugaacaagauuaccuacggagcuuguccuaaauaugucaagcagaauacgcugaaacuugccacaggcaugcgcaacgugcccgaaaagcagaccagagggaucuucggagcuauugccggcuuuaucgagaauggcugggaagggaugauugauggaugguacggcuuccggcaccaaaacagcgaggggaccggacaggcggccgaccugaaguccacacaggcugccaucgaucaaaucaauggcaaacucaaccgcguuauugagaagaccaaugaaaaauuccaccagaucgagaaggaauuuucugagguggaagggcggauucaggaccuggagaaauaugucgaggauacaaagaucgaccuuuggagcuacaacgcugaacugcucguggcccuggagaaucagcauacgauugaucugaccgacuccgaaaugaacaaacucuucgagaagacaagaagacaacugcgcgaaaacgccgaggauaugggcaauggaugcuuuaagaucuaucacaaaugugacaacgcuugcauugagagcauccggaauggcaccuacgaccaugauguuuauagagacgaagcgcuuaacaaucgcuuccagaucaaggggguggagcugaaaucuggauacaaggauuggauucucuggaucuccuuugccauuagcugcuuccugcuuugugucgugcugcucggcuuuaucaugugggcuugccagcgggggaacauuagauguaauaucugcaucuga

SEQ ID NO: 184664 - RNA, 1701 nt, Artificial Sequence
  derived and/or modified sequence opt5 from hemagglutinin__InfluenzaA__ABO52368
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucaauuguacccucauugacgcccugcugggcgauccccauugcgacguguuucaggaugagacgugggaccucuucgucgaacggucuaaagccuuuagcaacuguuauccuuacgaugugcccgacuaugcuucccugcgcucucuuguugccagcuccgggacccuggaguucaucacagaaggauuuaccuggacaggcgugacccagaauggcgggagcaacgcuugcaagagaggaccuggcucuggguucuuuucccggcucaauuggcugacgaaaagcggaucuacauaccccguccuuaacgugaccaugccuaauaacgauaauuucgacaagcuguauauuuggggcguucaccauccguccacaaaccaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgauguucuggugauuaauagcaacgggaaucucaucgcgccucgcggauacuuuaaaaugagaacaggcaagucuuccauuaugcggagcgacgcccccaucgacaccuguauuucugagugcaucacaccgaacgggagcaucccuaaugauaaacccuuccagaacgugaauaagauuaccuacggagcuuguccuaaauaugucaagcagaacacgcugaaacuugccacaggcaugcgcaaugugcccgaaaagcagaccagagggcuguuuggagcuaucgccggcuucauugagaacggcugggaagggaugaucgacggaugguacggcuuucggcaccaaaauuccgaggggaccggacaggcggccgaucucaagucuacacaggcugccauugaccaaaucaacggcaaacugaaucgcguuaucgagaagaccaacgaaaaauuccaccagauugagaaggaguucagcgaaguggaagggagaauccaggaucuugagaaauaugucgaggacacaaagauugaucugugguccuacaaugcugaacuccugguggcccuggagaaccagcauacgaucgaccucaccgauagcgaaaugaacaagcuguuugagaaaacacggagacaacuucgcgaaaaugccgaggacaugggcaacggaugcuucaagauuuaucacaaaugugauaaugcuugcaucgagucuauucggaacggcaccuacgaccaugacguuuauagagaugaagcgcugaauaaccgcuuucagaucaaggggguggagcucaaauccggauacaaggacuggauccuguggauuagcuucgccaucucuugcuuucuucugugugucgugcuccugggcuucauuaugugggcuugccagcgggggaauaucagauguaacauuugcaucuga

SEQ ID NO: 184665 - RNA, 1701 nt, Artificial Sequence
  derived and/or modified sequence opt5 from hemagglutinin__InfluenzaA__ABO52797
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaucauaacguuaccaaaggagugacggcuucuugcucccacaagggcaaaagcucuuuuuaucgcaaucuccuguggcuuaccgagaagaacggcuccuacccuagccuguccaagucuuaugucaauaacaaagaaaaggaggugcucguucuguggggagugcaucaccccagcaauaucaaagaccagaagacaauuuacagaaaagaaaacgccuacgucuccguggugagcucucacuauaaccggcgcuucaccccugagaucgcgaagagaccgaaaguccgggaucaggaagggcgcauuaauuacuauuggacacugcucgagcccggcgacaccaucauuuuugaggccaacgggaaucugaucgcuccuugguacgccuucgcucuuuccagaggauuuggcagcgggauuaucacgucuaacgccagcauggaugaaugugacgcgaagugccagacaccccaaggagccaucaauuccucucugccuuuccagaacguucaucccgugaccauuggcgaguguccgaaguaugugcggagcacaaaacuccgcauggucaccggccugagaaauaucccuuccauucagagccgggggcuuuuuggagcuaucgccggcuucauugaagggggauggaccggcaugaucgaugggugguacggauaucaccaucagaacgagcaaggcucuggcuacgcugccgaccagaaguccacacagagcgccaucaaugggauuacgaacaaaguuaauucuaucauugaaaagaugaacacccaguuuacagcugugggaaaagaguucaauaagcuggagaagcgcauggaaaaccucaauaaaaagguggaugacggcuuccuggacaucuggaccuacaacgcggagcugcucguccugcuugaaaacgagagaacacuggauuuucacgacuccaaugugaaaaaccucuaugaaaagguuaaaagccaacugaagaauaacgccaaggagauugggaauggaugcuucgaguuuuaccacaaauguaacaaugaaugcauggaguccgugaagaacggcaccuaugauuaccccaaauauucugaagagagcaaacuuaaucgggagaagaucgacggggucaagcuggaauccaugggcguguaccagauccucgcuauuuauucuacggucgccagcucccuggugcugcucguuagccugggagccaucucuuucuggaugugcuccaacggcagccuucagugucgcauuugcaucuga

SEQ ID NO: 184666 - RNA, 1698 nt, Artificial Sequence; identical to SEQ ID NO: 183766
  derived and/or modified sequence opt5 from hemagglutinin__InfluenzaA__ABP49217

SEQ ID NO: 184667 - RNA, 1698 nt, Artificial Sequence
  derived and/or modified sequence opt5 from hemagglutinin__InfluenzaA__ABP49305
augaaggccaaacugauggugcuccugugcaccuucacagcuacguacgccgacaccaucuguauuggcuaucacgcgaacaauagcacagauaccgucgacacaguucuugagaagaacgugaccgugacacauuccgucaaucugcucgaagauucucacaacgggaaacugugccuucugaagggaaucgcuccccuccagcugggcaauuguagcguggccggguggauucugggaaacccugagugcgaacuccugaucuccaaagagucuuggagcuacauuguugaaaccccgaaucccgagaacggcacguguuauccuggguacuuugccgacuaugaggaacuuagagagcaacuguccucugugagcuccuucgaacgguuugagaucuuccccaaggagagcucuuggccuaaucauaccgucacaggaguguccgcuagcugcucucacaacggcaaguccagcuuuuaccgcaaucuccuguggcuuaccggcaaaaacgggcuguaucccaaucucucuaaguccuacgccaacaauaaagaaaaggagguucuggugcuguggggaguccaucacccuccgaacaucggcgaucagagagcucucuaccacacagaaaacgccuaugugagcguggucuccucucauuacagccggcgcuucacccccgagauugcgaaaagaccuaagguucgggaccaggaagggcgcaucaauuauuacuggacgcugcuugagcccggagauacaauuaucuuugaggccaacggcaaucugauugcuccuugguaugccuucgcucucuccagaggguuuggaagcggcaucauuaccucuaacgcccccaugggcgaaugugacgcgaagugccagacaccgcaaggggccaucaauuccagccugccuuuccagaacgugcaccccgugaccaucggagaguguccuaaauacguccggucugcuaaacuucgcauggugaccggccugagaaauauucccagcauccagucccgggggcucuuuggagccauugcuggcuucaucgaagggggauggacaggcaugguugauggcugguauggguaccaucaccagaacgagcaaggaucuggcuacgccgccgaccagaaaagcacgcagaaugcuauuaacgggaucaccaauaaggugaacuccgucaucgaaaagaugaauacacaguuuaccgcggugggaaaggaguucaacaaacuggagcgcagaauggaaaaucugaacaagaagguugaugacggcuuccucgauauuuggacauauaacgccgagcugcuugugcugcucgaaaaugagcggacccuggacuuucacgacagcaacgucaaaaaucuuuacgaaaaggugaaaucucaacugaagaacaaugcuaaagagaucgggaacggcugcuucgaguuuuaucauaaguguaauaacgaaugcauggaguccgucaagaauggaacguacgauuaucccaaauacagcgaagagucuaagcucaaccgcgagaaaauugacggcgugaagcuggaauccauggggguuuaucagauccuggccauuuacagcacaguggccuccucucucguccugcuugugagccugggagcuaucuccuucuggaugugcucuaauggcagccuccaguguagaaucugcauuuga

SEQ ID NO: 184668 - RNA, 1701 nt, Artificial Sequence
  derived and/or modified sequence opt5 from hemagglutinin__InfluenzaA__ABP49316
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgccccgcugcagcugggcaaauguaauauugccggguggauccucggaaacccugagugcgaaucccuguucucuaagaaguccugguccuauauugcugagacccccaauucugaaaacggcacauguuaccccggguauuuugccgauuacgaggagcuucgggaacaacugagcuccgugagcucuuucgagcgcuuugaaaucuucccuaaagagagauccuggcccaagcauaauaucacccggggaguuacggcugccugcagccacaaaggcaagucuuccuuuuaucgcaaccuccuguggcuuaccgagaaaaauggcagcuacccuaaccugaagaagucuuaugugaauaacaaagaaaaggagguccucgugcuguggggaguucaucaccccuccaauauugaagaccagaaaacacuguacagaaaggagaacgcguacgugagcgucguguccucuaacuauaauaaacgguucaccccugaaaucgccgagcgcccgaaggugagagggcaggcuggccggauuaacuacuauuggacacuccuggagcccggggauaccaucauuuuugaagccaauggaaaccuuaucgcuccuuggcacgccuucgcgcugagccgcggcuuuggguccggaauuaucacgagcaaugccucuauggacgagugugauacaaaaugccagacaccccaaggcgcuaucaacuccagccucccuuuccagaauauucaucccgucaccaucggcgaauguccgaaguacguuagaucuaccaagcugcggauggugaccgggcuucgcaacauuccuagcauccaguccagaggacuguuuggcgccauugcuggguucaucgagggaggcuggacagggaugaucgacggaugguauggcuaccaccaucagaaugaacaaggcucuggguaugccgccgaucagaaaagcacgcagaacgcuauuaauggaaucaccaacaaggugaauagcgucauugagaaaaugaacacacaguuuaccgcggugggcaaggaguucaauaaacucgaaaagcggauggagaaccugaacaagaaaguugacgauggguuccuggacaucuggacauacaaugccgaacuccuggugcuucuggagaacgaacgcacccucgacuuucacgauagcaaugucaagaaccuguacgagaaagugaagucucaacuuaaaaauaacgcuaaggagauuggaaauggcugcuucgaauuuuaucacaaguguaacaaugagugcauggaauccguuaaaaacgggacguacgacuaucccaaguacagcgaggagucuaaacugaauagagaaaagaucgauggcgugaaacucgaguccaugggagucuaucagauccuggccauuuacagcacaguggccuccucucugguccuccuggugagccuuggcgcuaucuccuucuggaugugcucuaacgggagccugcagugucggauuugcaucuga

SEQ ID NO: 184669 - RNA, 1701 nt, Artificial Sequence
  derived and/or modified sequence opt5 from hemagglutinin__InfluenzaA__ABP49327
augaaggccagacugcucgugcugcuuugcgcucuggccgcgaccgacgcugauacaaucuguauuggcuaccacgccaacaauagcacggacaccgucgauacaguucucgagaaaaacgugaccgugacacauuccgucaaucugcuugaagacucucacaacgggaagcugugccggcucaaaggaaucgccccgcugcagcugcgcaaguguaauauugcuggcuggauccucgggaacccugagugcgaaagccugcuuuccgagagaucuuggagcuauauuguggaaacccccaauuccgagaacggaacauguuaccccggcgauuucaccaauuaugaggaacugcgggagcaacucucuagcguuuccagcuuugaacgcuucgagaucuuuccuaaagagucuuccuggcccaagcauaacacgaccagaggggugacagccgcuugcagccacgccggaaagucuuccuucuaccggaaucugcuuuggcugaccgaaaaagacggcagcuauccuaaccucaauaacucuuacgucaauaagaaaggcaaggaggugcugguucuguggggagugcaucaccccuccaacaucaaagaucagcagacacucuaucagaaggaaaacgcguacgucagcgugguguccucuaauuacaaccgcagauuuaccccugagauugccgaacggccgaagguccgcgggcaagcuggcagaaugaauuauuacuggacgcugcuuaaacccggggacacaaucauguucgaggccaacggaaaucugauugcuccuugguaugccuuugcgcucagccggggcuucggguccggaaucauuaccagcaacgccucuaugcacgagugugauacaaagugccagacaccccagggcgcuaucaauuccagccugccuuuucagaacauucaucccguuaccaucggcgaauguccgaaauacgugcgcucuaccaagcugagaauggugacggggcuucggaauaucccuagcauucaaucccgcggacucuucggcgccaucgcuggguuuauugagggaggcuggaccgggaugaucgacggaugguauggcuaccaccaucagaacgaacagggcucuggguaugccgccgaucagaaaagcacacaaaaugcuauuaacggaaucaccaauaaggucaacuccgugaucgagaaaaugaauacacaguucaccgcgguuggcaaggaauuuaacaaccuggagaagagaauggagaaucugaacaaaaagguggacgauggguuccucgacauuuggacguacaaugccgaacugcuuauccugcucgagaacgaacggacacuggacuuccacgauagcaaugucaaaaaccuuuacgagaaggugaaaucucagcugagaaauaacgcuaaggaaauuggaaauggcugcuuugaguucuaucacaaguguaacaaugagugcauggaauccguuaaaaacgggaccuacgacuaucccaaguacagcgaggaaucuaaacucaaucgcgagaagaucgauggcgugaaacuggaguccaugggagucuaucaaauucuggccaucuacagcaccguggccuccucucucguccugcuugugagccugggcgcuaucuccuuuuggaugugcucuaacgggagccuccagugucggauuugcaucuga

SEQ ID NO: 184670 - RNA, 1701 nt, Artificial Sequence
  derived and/or modified sequence opt5 from hemagglutinin__InfluenzaA__ABP49338
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucgcgaagagaccgaaaguccgggggcaggagggccgcauuaauuacuauuggacacugcucgagcccggggauaccaucauuuuugaagccaacggaaaucugaucgcuccuugguacgccuucgcucuuucuagaggcuuuggguccggaauuaucacgagcaacgccucuauggacgagugugauacaaagugccagacaccccaaggcgcgaucaauagcucccugccuuuccagaacguucaccccgugaccauuggcgaauguccgaaauaugugcggucuaccaagcuccgcauggucaccgggcugagaaauaucccuagcauucagucccggggacuuuuuggcgccaucgcuggguucauugagggaggcuggacagggaugaucgacggaugguacggcuaucaucaccagaacgaacaaggcagcggguacgccgcugaucagaagucuacgcagaaugccaucaacggaauuaccaauaaagugaacuccguuaucgagaagaugaauacacaguuuaccgccgugggcaaagaguucaacaagcuggaaaaacgcauggagaaucucaacaagaaggucgacgauggguuccuggacauuuggacauacaacgcugaacugcucgugcugcuugagaaugaaagaacccuggacuuucaugauagcaacguuaaaaaucucuaugagaaggugaaaucucaacugaagaacaaugcgaaagagaucggaaacggcugcuucgaauuuuaccacaaguguaauaacgagugcauggaauccgucaagaaugggacguaugacuaccccaaauauagcgaggaguccaaacuuaaccgggaaaagauugauggcgugaagcuggagucuaugggagucuaccagauccucgccaucuauagcacaguggcuuccucucugguucugcucgugagccugggcgccauuuccuucuggaugugcagcaaugggucucuucaguguagaaucugcauuuga

SEQ ID NO: 184671 - RNA, 1701 nt, Artificial Sequence
  derived and/or modified sequence opt5 from hemagglutinin__InfluenzaA__ABP49349
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacaaccacaaugggaaacugugcaagcucaaaggaaucgccccgcugcagcugggcaaguguagcauugccggguggauccucggaaacccugagugcgaaucccuguucucuaagaaaagcugguccuauauugcugagacccccaauucugaaaacggcacauguuaccccggguauuuugccgauuacgaggagcuuagagaacaacugagcuccgugagcucuuucgagcgguuugaaaucuucccuaaggaguccagcuggcccaaucauaacguuaccaaaggagugacggcuucuugcucccacaagggcaaaagcucuuuuuaucgcaaucuccuguggcuuaccgagaagaacggcuccuacccuaaucugagcaaguccuaugucaacaauaaagaaaaggaggugcucguucugugggggauccaucaccccucuaacauugaagaccagaaaacaaucuacagaaaggagaacgccuacgugagcgucguguccagccacuauaaucggcgcuucaccccugaaauugcgaaaagaccgaaggugcgggaucaggagggacgcaucaacuacuauuggacacugcucgagcccggcgacaccauuaucuuugaagccaaugggaaccugauugcuccuugguacgccuucgcucuuucuagaggauuuggcuccgggaucaucacgagcaaugccucuauggaugagugugacgcgaaaugccagacaccccugggagccauuaacagcucccucccuuuccaaaauguccaucccguuaccaucggcgaauguccgaaguaugugcggucuacaaagcugcgcauggugaccggccuuagaaacauuccuagcauccagucccgggggcuguuuggagcuauugccggcuucaucgaagggggauggaccggcaugaucgaugggugguacggauaucaccaucagaaugagcagggcagcggcuacgcugccgaccaaaaaucuacacaguccgccauuaacgggaucacgaauaaggucaacagcauuaucgagaaaaugaauacccaguuuacagcugugggaaaggaguucaacaaacucgaaaagcgcauggagaaucugaacaagaaaguugaugacggcuuccuggacauuuggaccuacaacgcggaacuccuggugcuucuggagaaugaaagaacacucgauuuucacgacucuaacgucaagaaucuguaugagaaagugaagucccagcuuaaaaacaaugccaaggagaucgggaacggaugcuucgaauuuuaccacaaguguaauaacgagugcauggaaagcguuaaaaauggcaccuaugauuaccccaaguauuccgaggagucuaaacugaaccgggaaaagaucgacggggugaaacucgagagcaugggcgucuaccaaauucuggcuaucuauuccacgguggccucuagccugguccuccuggugucccuuggagccauuagcuucuggaugugcucuaauggcucccugcagugucgcaucugcauuuga

SEQ ID NO: 184672 - RNA, 1701 nt, Artificial Sequence
  derived and/or modified sequence opt5 from hemagglutinin__InfluenzaA__ABP49360
augaaggccaagcugcucauccugcuuugcgcuuucaccgccacagacgcggauacgauuuguaucggcuaccacgcuaacaauagcaccgacacaguggauaccguccuggagaagaacguuacagugacccauuccgugaaucuccuggaagacucucacaacgggaaacuuugcagacugaagggaauugccccgcuccagcugggcaauuguagcaucgccggguggauucugggaaacccugagugcgaaucccucuuuucuaaaaagagcugguccuauaucgcugagacacccaauucugaaaacggcaccuguuaccccggguauuucgccgauuacgaggagcugcgggaacaacuuagcuccgucagcucuuuugagcgcuucgaaaucuuuccuaaggaguccagcuggcccaaucauacggugaccaaaggaguuacagcuucuugcucccacaacggcaagagcucuuucuauagaaaucugcucuggcugaccaaaaagaacggcuccuacccuaaucuuagcaaauccuaugugaacaauaaggagaaggaaguccuggugcucuggggaguucaucaccccucuaacauuggggaccagcgggccaucuaccacacagagaacgcguacgugagcgucguguccagccauuauaaucgcagauuuaccccugaaauugccaaacggccgaaggugcgcgaucaggagggcagaaucaacuacuauuggacgcugcuggaacccggggacacaauuaucuucgaggcuaauggaaaccucauugccccuugguacgcuuuugcccugucucggggcuucggguccggaaucaucaccagcaaugcgucuauggaugagugugacgccaaaugccagacaccccaaggcgcuauuaacagcucccuuccuuuucagaauguccaccccguuaccaucggcgaauguccgaaguaugugcgcucuaccaaacugagaauggugacagggcuccggaacauuccuagcauccagucccgcggacuguucggcgccauugcuggguuuaucgagggaggcuggacggggaugaucgauggaugguacggcuaucaucaccagaaugaacaaggcagcggguacgccgccgaccagaagucuacccagaacgcuauuaauggaaucacaaacaaagucaauuccgugauugagaagaugaacacccaguucacagcgguuggcaaggaguucaauaaacuugaaagacggauggagaaccugaacaagaaaguggaugacggguuucucgacaucuggaccuacaaugccgaacugcugguccuccuggagaacgaacgcacgcuugauuuccacgacagcaaugugaagaaccuguaugagaaaguuaagucucaacucaagaauaacgcuaaagaaauuggaaauggcugcuuugaguucuaccauaaguguaacaaugagugcauggaauccgugaaaaacgggacauaugauuaccccaaguauagcgaggaauccaaacugaauagagagaagaucgacggcgucaaacuugagucuaugggaguguaccagauccuggccauuuauagcaccgucgccuccucucucgugcugcugguuagccucggcgcuaucuccuuuuggaugugcagcaacgggucucugcagugucggauuugcaucuga

SEQ ID NO: 184673 - RNA, 1701 nt, Artificial Sequence; identical to SEQ ID NO: 183674
  derived and/or modified sequence opt5 from hemagglutinin__InfluenzaA__ABP49371

SEQ ID NO: 184674 - RNA, 1701 nt, Artificial Sequence; identical to SEQ ID NO: 184411
  derived and/or modified sequence opt5 from hemagglutinin__InfluenzaA__ABP49382

SEQ ID NO: 184675 - RNA, 1698 nt, Artificial Sequence
  derived and/or modified sequence opt5 from hemagglutinin__InfluenzaA__ABP49393
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggaauccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucugccaagcugagaauggugaccggacuccggaauauccccagcauucagucccgcggccuguucggggcuaucgccggauuuauugaaggcggguggacaggaaugguugacggcugguacggcuaucaucaccagaacgagcaagggucuggauacgcugccgaucagaaaagcacgcagaaugccaucaacggcaucaccaauaaggugaacuccgucauugaaaagaugaauacacaguucaccgcuguggggaaagaguucaacaaacuggagagacggauggaaaaucucaacaagaagguugacgauggauuucuggacaucuggacauacaacgcggagcuucuggugcuccuggaaaaugagcgcacccuugacuuccacgauagcaacgucaaaaaucuguaugaaaaggugaaaucucaacucaagaacaaugccaaagagauuggcaacgggugcuuugaguucuaccauaaguguaaugacgaaugcauggaguccgucaagaacggcacguaugauuaccccaaauauagcgaagagucuaagcugaauagagagcggaucgacggagugaaacuggaauccaugggcguuuaccagauucucgcuaucuauagcacaguggccuccucucugguccuucuggugagccucggggccaucuccuuuuggaugugcucuaacggaagccugcaguguagaauuugcaucuga

SEQ ID NO: 184676 - RNA, 1701 nt, Artificial Sequence
  derived and/or modified sequence opt5 from hemagglutinin__InfluenzaA__ABP49404
augaagaccaucauugcccugagcuacacacucugccugguguucgcucagaaacuucccggcaacgacaauuccacggccacccugugucucgggcaccaugcggucccuaacggaacaaucguuaagaccauuacaaaugaucaaaucgaggugaccaacgcuacagaacuggugcagucuagcuccaccggcgggauuugcgacucuccgcaccagauccuugauggagagaauuguacgcugaucggcgcccuccugggggacccccagugcgauggauuucaaaacaaaaagugggaccuguucgucgaaagaagcaaagccuauuccaauuguuacccuuaugaugugcccgacuacgcuucucuccggagccugguugccuccagcggcacccuugaguuuaacaaugaaucuuucaacuggacaggcgugacccagaaugggacauccagcgcuugcaagcgcagaucuaacaauuccuuuuucagccggcugaacuggcucacccaucugaaguuuaaauauccugcccuuaaugucacgaugcccaacaacgagaaguucgauaaacuguacauuuggggagugcaccauccuggcacauauaaugaccagaucucucucuacgcgcaggccuccgggcgcauuaccguuagcacaaagagaucccaacagaccgugaucccgaacauuggaucucggccccgcgucagagauaucccuagccggauuuccaucuacuggaccaucgugaaacccggcgacauucugcugaucaauagcacagggaaccucauugcuccucgcggauauuuuaagaucagaucuggcaaguccagcauuaugcggucugaugcccccaucggcaaauguaauagcgagugcaucacgccgaacggguccauuccuaaugacaagcccuuccagaacgugaaucgcaucaccuacggagcuuguccuagauaugucaaacagaacacacugaaacuugccaccggcaugcggaauguucccgaaaaacaaacacgcgggauuuuuggagcgaucgccggcuucauugagaacgggugggaaggaaugguggacggcugguacggcuuuagacaccagaauagcgaggggaucggacaggcugccgaucugaagucuacccaagcugccaucaaccagauuaauggcaaacucaaccggcugaucgggaagacgaacgagaaguuccaccagauugaaaaagaguucuccgaaguggagggaagaauccaggaccuugaaaaguaugucgaggauacaaaaauugaccuguggagcuacaaugccgagcuccugguggcucuggaaaaccaacauaccaucgaucucaccgacucugagaugaauaagcuguuugaacgcacaaagaagcagcuucgggagaacgcggaagauaugggcaaugggugcuucaagauuuaucacaaaugugacaacgccugcaucggcuccaucagaaauggaaccuacgaucaugacguuuaccgcgaugaggcucugaacaaucgguuucagauuaagggcguggagcucaaaagcggguauaaggacuggauccuguggauuucuuucgccaucuccugcuuucuucugugugucgcccuccugggauucauuaugugggcuugccagaaaggcaacaucagauguaauaucugcauuuga

SEQ ID NO: 184677 - RNA, 1701 nt, Artificial Sequence; identical to SEQ ID NO: 183674
  derived and/or modified sequence opt5 from hemagglutinin__InfluenzaA__ABP49415

SEQ ID NO: 184678 - RNA, 1701 nt, Artificial Sequence; identical to SEQ ID NO: 183674
  derived and/or modified sequence opt5 from hemagglutinin__InfluenzaA__ABP49426

SEQ ID NO: 184679 - RNA, 1689 nt, Artificial Sequence
  derived and/or modified sequence opt5 from hemagglutinin__InfluenzaA__ABP49437
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgagaucgccaccagaccuaaagugaacggacugggcggccggauggaauuuuccuggacacuccuggauaugugggacaccauuaacuucgagagcaccgggaaucuuaucgcucccgaauacggauuuaagaucucuaaacgcggcuccagcgggauuaugaagacagagggaacgcuggagaacugcgaaaccaaaugucaaacaccucucggcgccaucaauaccacacugcccuuccauaacgugcacccgcuuaccauuggggagugcccuaaguaugucaaauccgaaaagcugguucucgcgacgggacugagaaaugugccccagaucgagucucggggccuguuuggcgccauugcuggguucaucgaaggaggcuggcaggggaugguggauggaugguacggcuaucaucacagcaacgaccagggguccggcuacgccgcugauaaggagagcacacaaaaagccuuugacggaaucaccaauaaggucaacucugugauugagaaaaugaauacccaguucgaagcgguuggcaaggaguuuuccaaccucgaacgcagacuggagaaucuuaacaaaaagauggaagacggguuccuggauguguggacauauaaugccgagcuccugguccuuauggagaacgaacggacccuggacuuccacgauagcaaugugaagaaccucuacgacaaaguucgcaugcagcugagagauaacgugaaggagcugggaaauggcuguuuugaguucuaucauaaaugcgacgaugaguguaugaacucugucaagaaugggacauacgacuacccuaaauaugaggaagagagcaagcucaaccggaaugaaaucaagggagugaaacuguccucuaugggcgucuaccagauucuugcuaucuaugccacgguggcugggagccugucccucgccauuaugauggccggcaucagcuuuuggaugugcucuaacggaucccugcaaugcagaaucuguauuuga

SEQ ID NO: 184680 - RNA, 1701 nt, Artificial Sequence
  derived and/or modified sequence opt5 from hemagglutinin__InfluenzaA__ABP49448
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucucugagagaccgaagguccgggggcaggagggccgcauuaauuacuauuggacacugcucgaacccggggauaccaucauuuuugaggcgaacggaaaucugaucgccccuugguacgcuuucgcccuuuccagaggcuuugggagcggaauuaucacgucuaacgcuagcauggacgaaugugauacaaaaugccagacaccccaaggcgccaucaauuccucucugccuuuccagaacguucaccccgugaccauuggcgaguguccgaaguaugugcggagcaccaaacuccgcauggucaccgggcugagaaauaucccuuccauucagagccggggacuuuuuggcgcgaucgccggguucauugaaggaggcuggacagggaugaucgacggaugguacggcuaucaucaccagaacgagcaaggcucuggguacgcugccgaucagaaguccacgcagaaugcuaucaacggaauuaccaauaaggugaacagcguuaucgagaaaaugaauacacaguuuaccgccgugggcaaggaguucaacaaacuggaaaagcgcauggaaaaucucaacaaaaaggucgacgauggguuccuggacauuuggacauacaacgccgagcugcucgugcugcuugaaaaugagagaacccuggacuuucaugauucuaacguuaagaaucucuaugagaaagugaagucccaacugaaaaacaaugcuaaggaaaucggaaacggcugcuucgaguuuuaccacaaauguaauaacgaaugcauggagagcgucaagaaugggacguaugacuaccccaaguauuccgaggaaucuaaacuuaaccgggagaagauugauggcgugaaacuggaaagcaugggagucuaccagauccucgcgaucuauuccacaguggccucuagccugguucugcucgugucccugggcgcuauuagcuucuggaugugcucuaaugggucccuucaguguagaaucugcauuuga

SEQ ID NO: 184681 - RNA, 1689 nt, Artificial Sequence
  derived and/or modified sequence opt5 from hemagglutinin__InfluenzaA__ABP49459
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggacccccacgcugaauaagcgcagcacaccugauaucgccaccagacccaaagugaacggacaaggcggccggauggaguuuucuuggacacugcucgacaugugggauaccauuaacuucgaauccaccgggaaucugaucgcuccugaguacggauuuaagaucagcaaacgcgggucuuccggcauuaugaagacagaaggaacgcuuggcaacugcgagaccaaaugucagacaccccugggggccaucaauaccacacucccguuccauaacgugcacccucugaccauuggagagugccccaaguaugucaaaagcgaaaaacuuguucuggcgacgggccucagaaaugugccucagaucgagucccggggccuguuuggggccauugcuggauucaucgaaggcggguggcagggaaugguggacggcugguacggguaucaucacucuaacgaucaaggcagcggauacgccgcugacaaggaguccacacagaaagccuuugacggcaucaccaauaaggucaacagcgugauugaaaagaugaauacccaguucgaggcgguugggaaggaguuuucuaaccuggaacgcagacucgagaaucugaacaaaaagauggaagauggauuccuugacguguggacauauaaugccgagcugcucguccugauggaaaacgagcggacccuugauuuccacgacuccaaugugaagaaccuguacgauaaaguucgcaugcagcucagagacaacgugaaggagcugggcaauggguguuuugaguucuaucauaaaugcgaugacgaguguaugaacagcgucaagaauggaacauacgauuaccccaaauaugaagaggagucuaagcugaaccggaaugaaaucaagggcgugaaacucagcuccaugggggucuaccaaauucuggcuaucuaugccacgguggcuggcucucuuagccuggccauuaugauggccggaaucuccuuuuggaugugcagcaacggcucucuccagugcagaaucuguauuuga

SEQ ID NO: 184682 - RNA, 1689 nt, Artificial Sequence
  derived and/or modified sequence opt5 from hemagglutinin__InfluenzaA__ABP49470
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucagcaccucuacgcugaauaagcgcuccacacccgauaucgccaccagaccuaaagugaacgggcugggaggccggauggaguuuagcuggacacuccuggacaugugggauaccauuaacuucgaaucuaccggcaaucuuaucgcucccgaguacggguuuaagaucuccaaacgcggaagcuccggcauuaugaagacagaagggacgcugggaaacugcgagaccaaaugucaaacaccucucggcgccaucaauaccacacugcccuuccauaacgugcacccgcuuaccauuggggagugcccuaaguaugucaaaucugaaaagcugguucucgcgacgggacugagaaaugugccccagaucgagagccggggccuguuuggcgccauugcuggguucaucgaaggaggcuggcaggggaugguggacggaugguacggcuaucaucacuccaacgaucaggggagcggcuacgccgcugacaaggagucuacacaaaaagccuuugacggaaucaccaauaaggucaacuccgugauugagaaaaugaauacccaguucgaggcgguuggcaaggaguuuagcaaccucgaacgcagacuggagaaucuuaacaaaaagauggaagauggguuccuggacguguggacauauaaugccgagcuccugguccuuauggaaaacgagcggacccuggauuuccacgacucuaaugugaagaaccucuacgauaaaguucgcaugcagcugagagacaacgugaaggagcugggaaauggcuguuuugaguucuaucauaaaugcgaugacgaauguaugaacagcgucaagaaugggacauacgauuacccuaaauaugaagaggaguccaagcucaaccggaaugaaaucaagggagugaaacugucuagcaugggcgucuaccagauucuugcuaucuaugccacgguggcugggucccugagccucgccauuaugauggccggcaucucuuuuuggaugugcuccaacggaagccugcaaugcagaaucuguauuuga

SEQ ID NO: 184683 - RNA, 1701 nt, Artificial Sequence
  derived and/or modified sequence opt5 from hemagglutinin__InfluenzaA__ABP49492
augaagaccaucauugcccugagcuacaucuucugccucguguuugcucagggccugcccgggaacgacaauuccacagccacgcuuugucugggacaccaugcggucccuaacggcacccucguuaaaacaauuaccaaugaucaaaucgaggugacaaacgcuaccgaacuggugcagucuagcuccacagggaagauuugcgacaauccgcacagaauccuugauggaaucaacuguacccugauugacgcccuccugggcgauccccauugcgacggguuccagaaugagaaaugggaucuguuugucgaacggucuaaggccuucagcaacuguuauccuuacgacgugcccgauuaugcuucccuccgcucucugguugccagcuccggaacgcuugaguuuaucaaugaaggcuucaacuggaccggcgugacacagaaugggggaucuagcuccugcaaaagaggcccugacaacggguuuuucagccggcugaauuggcucuacaagucuggauccaccuaucccguccaaaacgugacaaugccuaauaacgauaacagcgacaagcuguacauuuggggcguucaccauccgucuaccgauaaagagcagacggaccuuuaugugcaggcuuccgggaaggucacagugagcaccaaacgcucccagcaaacagugauccccaaugucggaucuagaccuuggguucggggccugagcucccgcgugagcauuuacuggaccaucgugaagcccggcgacauucucgucaucaacucuaaugggaaccugaucgccccuagaggauacuuuaaaaugcggaccggcaaguccagcauuaugcgcucugaugcgcccaucgggacauguagcuccgagugcauuacgccgaauggaucuaucccuaacgacaagcccuuccagaaugugaacaaaauuaccuauggcgccuguccuaaguacguuaaacagaauacacugaagcucgcuaccgggaugagaaacgugcccgaaaaacagacacggggaaucuuuggcgccaucgcuggcuucauugagaaugggugggaaggaaugaucgauggcugguauggguuucgccaccaaaacagcgagggaaccggccaggccgcggaccugaaguccacgcaggccgcuauugaucaaaucaaugggaaacuuaacagagucauugagaagacaaaugaaaaguuccaccagaucgagaaagaguucagcgaaguggaaggccggauccaggaccuggagaaguacguugaggauaccaaaauugaccucuggucuuauaacgccgaacugcuuguggcucuggagaaccagcauaccaucgaucucacagacuccgaaaugaauaagcuguuugagaaaacccgcagacaacugcgggaaaacgccgaggauaugggaaauggcugcuucaagauuuaccacaagugugacaacgccugcaucgggagcauuagaaauggaacauaugaccaugaugucuaccgcgacgaggcucucaacaaucgguuucagaucaaaggcguggaacugaagucuggguacaaagauuggauucuuuggaucuccuucgcgaucagcugcuuucugcucugugucgugcugcuuggauucauuaugugggccugccagaagggcaacaucagauguaauauuugcaucuga

SEQ ID NO: 184684 - RNA, 1701 nt, Artificial Sequence; identical to SEQ ID NO: 184580
  derived and/or modified sequence opt5 from hemagglutinin__InfluenzaA__ABP49503

SEQ ID NO: 184685 - RNA, 1701 nt, Artificial Sequence
  derived and/or modified sequence opt5 from hemagglutinin__InfluenzaA__ABP49514
augaagaccaucauugcccugagcuacaucuucuaucucgcucugggccaggaccuucccgggaacgauaauuccacagccacgcugugccucggacaccaugcggugccuaacggcacccuggucaaaacaauuaccaaugaccaaaucgagguuacaaacgcuaccgaacuugugcagucuagcuccacagggaagauuuguaauaacccgcacagaauccuggauggaaucgacugcacccucauugaugcccugcugggcgacccccauugugauguguuucagaaugagacgugggaccucuucgucgaacggucuaaagccuuuagcaacugcuacccuuaugaugugcccgacuacgcuucccugcgcucucuuguugccagcuccgggacccuggaguucaucacagaaggauuuaccuggacaggcgugacccagaauggcgggagcaacgcuuguaagagaggaccuggcucuggguucuuuucccggcucaauuggcugacgaaaagcggaucuacauaucccguccuuaacgugaccaugccuaauaacgauaauuucgacaagcuguacauuuggggcguucaccauccguccacaaaccaagagcagaccagccucuaugugcaggccucugggcgcgucaccguguccacaagacggagccagcaaacgaucauucccaacaucggaucccgcccuugggugagaggccugucuagccggauuuccaucuacuggaccaucgucaagcccggcgauguucuggugauuaauagcaacgggaaucucaucgcgccucgcggauacuuuaaaaugagaacaggcaagucuuccauuaugcggagcgacgcccccaucgauaccugcauuucugaguguaucacaccgaacgggagcaucccuaaugacaaacccuuccagaacgugaauaagauuaccuauggagcuugcccuaaauacgucaagcagaacacgcugaaacuugccacaggcaugcgcaaugugcccgaaaagcagaccagagggcuguuuggagcuaucgccggcuucauugagaacggcugggaagggaugaucgacggaugguauggcuuucggcaccaaaauuccgaggggaccggacaggcggccgaucucaagucuacacaggcugccauugaccaaaucaacggcaaacugaaucgcguuaucgagaagaccaacgaaaaauuccaccagauugagaaggaguucagcgaaguggaagggagaauccaggaucuugagaaauacgucgaggacacaaagauugaucugugguccuauaaugcugaacuccugguggcccuggagaaccagcauacgaucgaccucaccgauagcgaaaugaacaagcuguuugagaaaacacggagacaacuucgcgaaaaugccgaggacaugggcaacggauguuucaagauuuaccacaaaugcgauaaugcuuguaucgagucuauucggaacggcaccuaugaccaugacguuuacagagaugaagcgcugaauaaccgcuuucagaucaaggggguggagcucaaauccggauacaaggacuggauccuguggauuagcuucgccaucucuugcuuucuucugugcgucgugcuccugggcuucauuaugugggcuugucagcgggggaauaucagaugcaacauuuguaucuga

SEQ ID NO: 184686 - RNA, 1701 nt, Artificial Sequence
  derived and/or modified sequence opt5 from hemagglutinin__InfluenzaA__ABQ01311
augaaggccagacugcucauccugcuuugcgcucugagcgccaccgacgcggauacaauuuguaucggcuaccacgcuaacaauuccacggacaccguggauacaguccucgagaaaaacguuaccgugacacauucugugaaucugcuugaagacagccacaacgggaagcugugccggcucaaaggaauugcuccccugcagcugggcaaguguaauaucgccggguggauucucggaaacccugagugcgaaucccugcuuucuaaucgcagcugguccuauaucgccgagaccccgaacucugaaaauggcacauguuaccccggggauuucgccgacuaugaggagcugagagaacaacucagcuccgucagcucuuuugagcgguucgaaaucuuuccuaaagagcgcuccuggcccaagcauaacauuaccagaggagugacggcugccugcagccacgcgaagaaaucuuccuucuacaagaaucugcuuuggcugaccgaggccaacggcagcuauccuaaucucucuaaauccuacguuaacaauaaggaaaaagaggugcugguccuguggggcgugcaucaccccagcaagaucgaagaucagcggacacucuaucgcaaggagaacgcuuacguuuccguggucucuagcaacuacaauagacgguuuaccccugaaauugccgagcgcccgaaagugagagggcaggcuggacggaugaacuauuacuggacacugcuugagcccggcgacaagaucauuuucgaagccaaugggaaccugaucgcgccuugguaugccuuugcucucucccgcggacugggcagcgggauuaucaccucuaaugccuccauggaugagugugacacgaaaugccagacaccccaaggagcuaucaacagcucucuuccuuuccagaauauucaccccgugaccaucggcgaauguccgaaguacgucagaagcacaaaacugcggaugguuaccggccuccgcaacauuccuuccauccagucuagagggcuguuuggagccauugccggcuucaucgaagggggauggaccggcaugguggaugggugguauggauaccaucaccagaaugagcaaggcagcggcuaugcugcggaccagaaguccacacagaacgccaucaaugggauuacgaacaaagugaauagcgucaucgagaagaugaacacccaguuuacagcugugggaaaggaguucaauaaacuggaaaagcggauggagaaccucaacaaaaagguugaugacggcuuucuggacauuuggaccuacaaugccgaacuucuggugcuccuggagaacgaaagaacacuugauuuccaugacucuaaugucaaaaaccuguacgagaaggugaagaaucaacuccgcaacaaugccaaagagaucgggaacggaugcuucgaauuuuaucacaagugugauaaugagugcauggaauccguuaaaaacggcaccuacgacuaucccaaguacagcgaggagucuaaacugaaucgggaaaagauugauggggugaagcuggaguccaugggcgucuaucagauccucgcuaucuacagcacgguggccuccucucugguccuucuggugagccucggagcgauuuccuucuggaugugcucuaacggcagccugcaguguagaaucugcauuuga

SEQ ID NO: 184687 - RNA, 1701 nt, Artificial Sequence
  derived and/or modified sequence opt5 from hemagglutinin__InfluenzaA__ABQ01322
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcaucugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacagcuguccagcgugucuuccuucgagcgcuuugaaaucuucccuaaagagagaagcuggcccaagcacaacguuacccggggagugacggcugccugcucucauaaaggcaaguccagcuuuuaucgcaaucuccuguggcuuaccgagaaaaacggcucuuacccuaaucuguccaagagcuaugucaacaauaaggaaaaagaggugcucguucuguggggagugcaccaccccuccaacaucgaagaccaaaagacaauuuacagaaaagagaaugcguacgucucuguggugagcuccaacuauaaccggcgcuucaccccugaaaucgccaagagaccgaaaguccgggggcaggagggccgcauuaauuacuauuggacacugcucgagcccggggauaccaucauuuuugaagcuaacggaaaucugaucgccccuugguacgcuuucgcccuuagcagaggcuuugggucuggaauuaucacguccaacgcgagcauggacgagugugaugccaagugccagacaccccagggcgcuaucaauucuagccugccuuuccaaaacguucaucccgugaccauuggcgaauguccgaaauaugugcgguccacaaagcuccgcauggucaccgggcugagaaauaucccuucuauucagagccggggacuuuuuggcgccaucgcuggguucauugagggaggcuggaccgggaugaucgacggaugguacggcuaucaccaucagaacgaacagggcuccggguacgccgccgaucaaaagagcacacagaaugcuaucaacggaauuacgaauaaagugaacucuguuaucgagaagaugaauacccaguuuacagcggugggcaaagaguucaacaagcuggaaaaacgcauggagaaucucaacaagaaggucgacgauggguuccuggacauuuggaccuacaacgccgaacugcucgugcugcuugagaaugaaagaacacuggacuuucacgauuccaacguuaaaaaucucuaugagaaggugaaaagccagcugaagaacaaugcuaaagagaucggaaacggcugcuucgaauuuuaccacaaguguaauaacgagugcauggaaucugucaagaaugggaccuaugacuaccccaaauauuccgaggagagcaaacuuaaccgggaaaagauugauggcgugaagcuggaguccaugggagucuaccaaauccucgccaucuauucuacgguggccagcucccugguucugcucgugucucugggcgcuauuagcuucuggaugugcuccaaugggagccuucaguguagaaucugcauuuga

SEQ ID NO: 184688 - RNA, 1701 nt, Artificial Sequence; identical to SEQ ID NO: 183674
  derived and/or modified sequence opt5 from hemagglutinin__InfluenzaA__ABQ01333

SEQ ID NO: 184689 - RNA, 1701 nt, Artificial Sequence
  derived and/or modified sequence opt5 from hemagglutinin__InfluenzaA__ABQ01344
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcagaauuucuaucuacuggaccauugucaaacccggagauauccugcucaucaauuguacaggcaaccugauugccccucggggguauuucaagauccgcuccggaaagagcucuauuaugagaagcgacgcuuccaucggcaaaugcaauucugaauguauuacccccaacggcagcaucccgaaugacaagccuuuucagaacguuaaucggaucaccuacggggccugcccccgcuaugugaaacagaacacacuuaagcuggcgacgggaaugagaaaugugccugagaaacaaacccggggcauuuucggggccaucgcuggauuuauugaaaacggcugggaggggauggucgauggaugguacggcuuccgccaccaaaauuccgagggcacagggcaggccgcugaccucaagagcacccaggccgccaucaaccagauuaauggaaaacugaacagacuuaucggcaagacaaaugaaaaguuucaucagaucgagaaagaguucucugaaguggaagggcggauucaggaucuggagaaguauguugaggacaccaaaaucgaucucugguccuacaacgcugaacugcugguggcgcucgagaaccaacacacgauugaccugacagauagcgaaaugaauaaacuuuucgagagaaccaagaagcagcugcgcgaaaacgccgaggacaugggaaauggcuguuuuaagaucuaucauaaaugcgauaacgcuugcauugggucuauccggaauggcaccuacgaccacgaugucuacagagacgaggcccucaacaaucgcuuccagauuaagggaguggaacugaaauccggcuauaaggacuggauccuuuggaucagcuuugccauuuccuguuuccugcucugcguugugcugcugggguuuaucaugugggcuugucagaaaggaaacauucggugcaauaucuguauuuga

SEQ ID NO: 184690 - RNA, 1689 nt, Artificial Sequence
  derived and/or modified sequence opt5 from hemagglutinin__InfluenzaA__ABQ01355
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgggaugggcugugcuaucccgggagcuuuaaugacuacgaggaacuuaagcaucugcucuccucugucaagcacuucgaaaaagugcgcauucugccuaaggauagauggacacaacauaccacaaccggcggcagccgggccugugccguuuccgggaaccccucuuucuuccgcaauaugaucuggcuuacgaaaaagggaagcaacuauccuguggcuaaaggcuccuacaauaacaccagcggggagcagaugcugauuaucuggggaguccaccacccgauugacgagacagaacagagaacccucuaucagaauguggagacauacguuucuguggucaccuccacgcugaacaagcggagcacacccaagaucgccacccgcccuaaagugaauggccugggaggaagaauggaauuuucuuggacacuccuggauaugugggacaccaucaacuucgaguccaccggcaaccuuauugcucccgaauacggcuuuaagaucagcaaacgggggucuuccggaauuaugaagacagagggcacgcuggagaauugcgaaaccaaaugucaaacaccucucggggccaucaacaccacacugcccuuccauaaugugcacccgcuuaccauuggagagugcccuaaguaugucaaaagcgaaaagcugguucucgcgacgggccugcgcaacgugccccagaucgaguccagagggcuguuuggagccaucgcuggcuucauugaaggcggguggcagggaaugguggauggcugguacggguaucaucacucuaaugaccagggaagcggcuacgccgcugauaaggaguccacacaacgggccuuugacgggaucaccaacaaagucaauagcgugauugagaagaugaacacccaguucgaagcgguuggcaaagaguuuucuaaucucgaacgcagacuggagaaccuuaauaagaaaauggaagacggauuccuggauguguggacauauaacgccgagcuccugguccuuauggagaaugaacggacccuggacuuccacgauuccaacgugaagaaucucuacgacaagguuagaaugcagcugcgcgauaacgugaaagagcugggcaacggguguuuugaauuuuaucauaagugcgacgaugaguguaugaauagcgucaaaaacggaacauacgacuacccuaaguaugaggaagagucuaaacucaaucggaacgaaaucaagggcgugaagcugagcuccaugggggucuaccagauucuugcuaucuaugccacgguggcuggaucucugagccucgccaucaugauggccggcauuuccuuuuggaugugcagcaaugggucucugcaaugcagaaucuguauuuga

SEQ ID NO: 184691 - RNA, 1701 nt, Artificial Sequence
  derived and/or modified sequence opt5 from hemagglutinin__InfluenzaA__ABQ01366
augaagaccaucauugcccugagcuacaucuucugccucguguuugcucaggaccugcccggcaacgauaauuccacagccacgcuuugucuggggcaccaugcggucccuaacggaacccucguuaaaacaauuaccaaugaccaaaucgaggugacaaacgcuaccgaacuggugcagucuagcuccacaggcaagauuugcgauaauccgcacagaauccuugacgggaucaacuguacccugauugaugcccuccugggagacccccauugcgauggcuuccagaaugagaaaugggaccuguuugucgaacggucuaaggccuucagcaacuguuauccuuacgaugugcccgacuaugcuucccuccgcucucugguugccagcuccgggacgcuugaguuuaucaaugaaggauucaacuggaccggcgugacacagaauggcgggagcucugcuugcaaaagaggaccugauaacggcuuuuucucccggcugaauuggcucuacaagagcgggucuaccuaucccguccaaaacgugacaaugaccaauaacgacaacuccgauaagcuguacauuuggggaguucaccauccuagcacggacaaagagcagacagaccuuuaugugcaggccucuggcaaggucaccguguccacaaaacgcagccagcaaaccaucauuccgaaugugggguccagacccuggguccggggacugucuagccgcguuuccaucuacuggaccauugugaagccuggcgauauccucgugaucaacagcaauggcaaccugauugcgcccagaggguacuuuaaaaugcggacaggaaagucuuccaucaugcgcagcgacgccccuauuggcacguguucuagcgagugcaucacccccaauggguccauuccgaacgauaagccuuuccagaaugucaacaaaaucacauauggagcuugucccaaguacgugaaacagaauacccugaagcucgccacaggcaugagaaacguuccugaaaaacagacccgggggaucuuuggagcuauugccggcuucaucgagaauggcugggaagggaugauugacggaugguauggcuuucgccaccaaaacucugaggggacgggacaggcggccgaucuuaagagcacacaggcugccaucgaccaaauuaauggcaaacugaacagagugaucgagaagaccaaugaaaaguuccaccagaucgagaaagaguucuccgaagucgaagggcggauucaggaucuggagaaguacguggaggacaccaaaaucgaucucuggagcuauaacgcugaacugcuuguugcccuggagaaccagcauacaauugaccucaccgauucugaaaugaauaagcuguuugagaaaacacgcagacaacugcgggaaaacgccgaggacaugggcaauggaugcuucaagaucuaccacaagugugacaacgcuugcauuggcuccaucagaaaugggacguaugaucaugacguguaccgcgaugaggcgcucaacaaucgguuucagauuaaaggagucgaacuuaagagcggcuacaaagacuggauccuguggaucucuuucgccauuuccugcuuucugcucugugugguccugcuuggguucaucaugugggcuugccagaagggaaacauuagauguaauaucugcauuuga

SEQ ID NO: 184692 - RNA, 1701 nt, Artificial Sequence; identical to SEQ ID NO: 184457
  derived and/or modified sequence opt5 from hemagglutinin__InfluenzaA__ABQ44383

SEQ ID NO: 184693 - RNA, 1701 nt, Artificial Sequence; identical to SEQ ID NO: 183657
  derived and/or modified sequence opt5 from hemagglutinin__InfluenzaA__ABQ44405

SEQ ID NO: 184694 - RNA, 1701 nt, Artificial Sequence
  derived and/or modified sequence opt5 from hemagglutinin__InfluenzaA__ABQ44416
augaaggccaagcugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaaaggagugacagcuucuugcucccacaagggcaaaagcucuuucuauagaaaccugcucuggcugaccgagaagaauggcuccuacccuaaccuuagcaaauccuaugucaauaacaaggaaaaggaggugcugguucucuggggagugcaucaccccucuaauaucggggaccagcgggccauuuaccacacagaaaacgcguacgucagcgugguguccagccauuauaaccgcagauuuaccccugagaucgccaaacggccgaagguccgcgaucaggaaggcagaauuaauuacuauuggacgcugcuggagcccgaggacacaaucauuuucgaagcuaacgggaaucucaucgccccuugguacgcuuuugcccugucucggggauucggcuccgggauuaucaccagcaacgcgucuauggaugagugugacgccaaaugccagacaccccaaggagcuaucaauagcucccuuccuuuucagaacguucaccccgugaccauuggcgaauguccgaaguaugugcgcucuaccaaacugagaauggucacaggccuccggaauaucccuagcauucagucccgcgggcuguucggagccaucgcuggcuuuauugaagggggauggacgggcaugaucgaugggugguacggauaucaucaccagaacgaacaaggcagcggcuacgccgccgaccagaagucuacccagaaugcuaucaacgggauuacaaauaaagugaacuccguuaucgagaagaugaauacccaguucacagcggugggaaaggaguucaacaaacuugaaagacggauggagaaucugaacaagaaagucgaugacggcuuucucgacauuuggaccuacaacgccgaacugcuggugcuccuggagaaugaacgcacgcuugauuuccacgacagcaacguuaagaaucuguaugagaaagugaagucucaacucaagaacaaugcuaaagagaucgggaacggaugcuuugaguucuaccauaaguguaauaacgagugcauggaauccgucaaaaauggcacauaugauuaccccaaguauagcgaggaguccaaacugaacagagaaaagauugacggggugaaacuugagucuaugggcgucuaccagauccuggccaucuauagcaccguggccuccucucucguucugcuggugagccucggagcuauuuccuuuuggaugugcagcaauggcucucugcagugucggaucugcauuuga

SEQ ID NO: 184695 - RNA, 1701 nt, Artificial Sequence; identical to SEQ ID NO: 183280
  derived and/or modified sequence opt5 from hemagglutinin__InfluenzaA__ABQ44427

SEQ ID NO: 184696 - RNA, 1689 nt, Artificial Sequence
  derived and/or modified sequence opt5 from hemagglutinin__InfluenzaA__ABQ44438
auggccaucauuuacuucauccugcucuuuaccgcugugagaggcgaccagauuugcaucggguaucacgccaacaauagcacagagaaggucgauacgauucuggaacggaacguuaccgugacacaugcgaaagacauccuugagaagacccacaauggaaaacuguguaagcucaacggcauucccccucuggaacuuggggauugcuccaucacaggauggcugcucggcaauccggagugugaccgccugcugagagugcccgaauggucuuacaucauggagaaagagaacccucgguauagccucugcuaccccggguccuucaaugauuaugaggaacugaagcaucuucugucuagcgucaagcacuuugaaaaagugcgcauucucccuaaggacggauggacccaacauacaaccuccggcggcucuaaggcuugugccguuagcgggaaguccagcuucuuuagaaacaugguguggcugacgaaaaagggacccaauuacccugucgccaagcggucuuauaacaauaccuccggcgagcagaugcuuaucauuuggggagugcaccacccgaacgaugaggcugaacagagcgcccuguaccagaaaguugggacauacgugucugcuuccaccagcacacucaauaagcgcucuacccccgagaucgccgcgagaccugaagucaacggccuggggucccggauggaguucagcuggacgcugcucgacgugugggauacaauuaauuuugaauccaccggaaaccugguggcccccgaguauggcuucaaaaucucuaagcgcggcagcuccgggaucaugaaaacagagggaacccuuggcaacugcgaaaccaagugucaaacaccucugggggcuauuaauacgacccuccccuuucauaacguccacccgcugacaaucggagagugcccuaaauacguuaagagcgaaaaacuugugcuggccaccggccucagaaaugugccccagauugagucucgggggcuguucggagcuaucgccggcuuuauugaaggcggguggcagggaauggucgacggcugguauggguaccaucacuccaacgaucagggaagcggcuaugcggccgacaaagagucuacacaaaaggcuuucgaucgcaucaccaauaaagugaacagcguuaucgagaagaugaauacgcaguuugaagccguggggaaagaguucuccaaccuggaaaagagacucgagaaucugaacaagaaaauggaagacggcuuccuugacgucuggacauacaaugcugagcugcucgugcugauggagaacgaacggacccuugauuuucacgacucuaauguuaagaaccuguauaauaaagugcgcaugcagcucagagauaacgucaaggagcugggaaacggcuguuucgaauuuuaccauaaaugcgacgaugaguguaugagcuccgugaagaaugggaccuacgacuauccuaaguacgaggaagagagcaaacugaagcggaacgaaauuaaaggagucaagcucucuuccaugggcguguaucagauccuggccauuuacgccacaguugcugggagccuuucucuggcgaucaugauugccggaaucucccucuggaugugcagcaauggcucccugcaaugcagaaucuguauuuga

SEQ ID NO: 184697 - RNA, 1689 nt, Artificial Sequence
  derived and/or modified sequence opt5 from hemagglutinin__InfluenzaA__ABQ44460
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugaucuggcuuacgaagaaaggauccaacuauccuguggcuaagggcagcuacaauaacaccucuggggagcagaugcugauuaucuggggaguccaccacccgaaugacgagacagaacagcggacccucuaucagaacgugggcacauacguuuccguggggaccagcacgcugaauaagcgcucuacacccgauauugccaccagaccuaaagucaacggacugggcucccggauggaguuuagcuggacacuccuggacaugugggauaccaucaacuucgaaucuaccggcaaucuuaucgcucccgaguacggguuuaagauuuccaaacgcggaagcuccggcaucaugaagacagaagggacgcugggaaacugcgagaccaaaugucaaacaccucucggcgccauuaauaccacacugcccuuccauaacgugcacccgcuuaccaucggggagugcccuaaguaugugaaaucugaaaagcugguccucgcgacgggacugagaaauguuccccagauugagagccggggccuguuuggcgccaucgcuggguucaucgaaggaggcuggcaggggaugguggacggaugguacggcuaucaucacuccaacgaucaggggagcggcuacgccgcugacaaggagucuacacaaaaagccuuugacggaauuaccaauaaggugaacuccgucaucgagaaaaugaauacccaguucgaggcggugggcaaggaguuuagcaaccucgaacgcagacuggagaaucuuaacaaaaagauggaagauggguuccuggacguuuggacauauaaugccgagcuccuggugcuuauggaaaacgagcggacccuggauuuccacgacucuaaugucaagaaccucuacgauaaagugcgcaugcagcugagagacaacguuaaggagcugggaaauggcuguuuugaguucuaucauaaaugcgaugacgaauguaugaacagcgugaagaaugggacauacgauuacccuaaauaugaagaggaguccaagcucaaccggaaugaaauuaagggagucaaacugucuagcaugggcguguaccagauccuugcuauuuaugccacggucgcugggucccugagccucgccaucaugauggccggcaucucuuuuuggaugugcuccaacggaagccugcaaugcagaauuuguaucuga

SEQ ID NO: 184698 - RNA, 1701 nt, Artificial Sequence
  derived and/or modified sequence opt5 from hemagglutinin__InfluenzaA__ABQ44471
augaaggccagacugcucauccugcuuugcgcucugagcgccaccgacgcggauacaauuuguaucggcuaccacgcuaacaauuccacggacaccguggauacaguccucgagaaaaacguuaccgugacacauucugugaaucugcuugaagacagccacaacgggaagcugugccggcucaaaggaauugcuccccugcagcugggcaaguguaauaucgccggguggauucucggaaacccugagugcgaaucccugcuuucuaaucgcagcugguccuauaucgccgagaccccgaacucugaaaauggcacauguuaccccggggauuucgccgacuaugaggagcugagagaacaacucagcuccgucagcucuuuugagcgguucgaaaucuuuccuaaagagcgcuccuggcccaagcauaacauuaccagaggagugacggcugccugcagccacgcgaagaaaucuuccuucuacaagaaucugcuuuggcugaccgaggccaacggcagcuauccuaaucucucuaaauccuacguuaacaauaaggaaaaagaggugcugguccuguggggcgugcaucaccccagcaacaucgaagaucagcggacacucuaucgcaaggagaacgcuuacguuuccguggucucuagcaauuacaacagacgguuuaccccugaaauugccgagcgcccgaaggugagagggcaggcuggacggaugaauuauuacuggacacugcuugagcccggcgacaaaaucauuuucgaagccaacgggaaucugaucgcgccuugguaugccuuugcucucucccgcggacugggcagcgggauuaucaccucuaacgccuccauggaugagugugacacgaagugccagacaccccaaggagcuaucaauaacagccuuccuuuccagaauauucaccccgugaccaucggcgaauguccgaaauacgucagaucuacaaagcugcggaugguuaccggccuccgcaacauuccuagcauccaguccagagggcuguuuggagccauugccggcuucaucgaagggggauggaccggcaugguggaugggugguauggauaccaucaccagaaugaacaaggcucuggcuaugcugcggaccagaaaagcacacagaacgccaucaaugggauuacgaacaaggucaauuccgugaucgagaaaaugaacacccaguuuacagcugugggaaaggaguucaacaagcuggaaaaacggauggagaaucucaacaagaaaguugaugacggcuuucuggacauuuggaccuacaaugccgaacuucuggugcuccuggagaacgaaagaacacuugauuuccaugacagcaaugucaagaaccuguacgagaaagugaagaaucaacuccgcaacaaugccaaggagaucgggaacggaugcuucgaauuuuaucacaaaugugauaaugagugcauggaaucuguuaagaacggcaccuacgacuaucccaaauacuccgaggagagcaagcugaaucgggagaaaauugauggggugaagcuggagucuaugggcgucuaucagauccucgcuaucuacuccacgguggccagcucccugguccuucuggugucucucggagcgauuagcuucuggaugugcuccaacggcucucugcaguguagaaucugcauuuga

SEQ ID NO: 184699 - RNA, 1701 nt, Artificial Sequence
  derived and/or modified sequence opt5 from hemagglutinin__InfluenzaA__ABR15797
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucgacuguacccucauugaugcccugcugggcgacccccauugcgauguguuucagaaugagacgugggaccucuucgucgaacggucuaaagccuuuagcaacuguuauccuuacgaugugcccgacuaugcuucccugcgcucucuuguugccagcuccgggacccuggaguucaucacagaaggauuuaccuggacaggcgugacccagaauggcgggagcaacgcuugcaagagaggaccuggcucuggguucuuuucccggcucaauuggcugacgaaaagcggaucuacauaccccguccuuaacgugaccaugccuaauaacgauaauuucgacaagcuguauauuuggggcguucaccauccguccacaaaccaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgauguucuggugauuaauagcaacgggaaucucaucgcgccucgcggauacuuuaaaaugagaacaggcaagucuuccauuaugcggagcgacgcccccaucgacaccuguauuucugagugcaucacaccgaacgggagcaucccuaaugauaaacccuuccagaacgugaauaagauuaccuacggagcuuguccuaaauaugucaagcagaacacgcugaaacuugccacaggcaugcgcaaugugcccgaaaagcagaccagagggcuguuuggagcuaucgccggcuucauugagaacggcugggaagggaugaucgacggaugguacggcuuucggcaccaaaauuccgaggggaccggacaggcggccgaucucaagucuacacaggcugccauugaccaaaucaacggcaaacugaaucgcguuaucgagaagaccaacgaaaaauuccaccagauugagaaggaguucagcgaaguggaagggagaauccaggaucuugagaaauaugucgaggacacaaagauugaucugugguccuacaaugcugaacuccugguggcccuggagaaccagcauacgaucgaccucaccgauagcgaaaugaacaagcuguuugagaaaacacggagacaacuucgcgaaaaugccgaggacaugggcaacggaugcuucaagauuuaucacaaaugugauaaugcuugcaucgagucuauucggaacggcaccuacgaccaugacguuuauagagaugaagcgcugaauaaccgcuuucagaucaaggggguggagcucaaauccggauacaaggacuggauccuguggauuagcuucgccaucucuugcuuucuucugugugucgugcuccugggcuucauuaugugggcuugccagcgggggaauaucagauguaacauuugcaucuga

SEQ ID NO: 184700 - RNA, 1701 nt, Artificial Sequence
  derived and/or modified sequence opt5 from hemagglutinin__InfluenzaA__ABR15808
augaaggccagacugcucauccugcuuugcgcucugagcgccaccgacgcggauacaauuuguaucggcuaccacgcuaacaauuccacggacaccguggauacaguccucgagaaaaacguuaccgugacacauucugugaaucugcuugaagacagccacaacgggaagcugugccggcucaaaggaauugcuccccugcagcugggcaaguguaauaucgccggguggauucucggaaacccugagugcgaaucccugcuuucuaaucgcagcugguccuauaucgccgagaccccgaacucugaaaauggcacauguuaccccggggauuucgccgacuaugaggagcugagagaacaacucagcuccgucagcucuuuugagcgguucgaaaucuuuccuaaagagcgcuccuggcccaagcauaacauuaccagaggagugacggcugccugcagccacgcgaagaaaucuuccuucuacaagaaucugcuuuggcugaccgaggccaacggcagcuauccuaaucucucuaaauccuacguuaacaauaaggaaaaagaggugcugguccuguggggcgugcaucaccccagcaacaucgaagaucagcggacacucuaucgcaaggagaacgcuuacguuuccguggucucuagcaauuacaacagacgguuuaccccugaaauugccgagcgcccgaaggugagagggcaggcuggacggaugaauuauuacuggacacugcuugagcccggcgacaaaaucauuuucgaagccaacgggaaucugaucgcgccuugguaugccuuugcucucucccgcggacugggcagcgggauuaucaccucuaacgccuccauggaugagugugacacgaagugccagacaccccaaggagcuaucaauagcucucuuccuuuccagaacauucaccccgugaccaucggcgaauguccgaaauacgucagaagcacaaagcugcggaugguuaccggccuccgcaauauuccuuccauccagucuagagggcuguuuggagccauugccggcuucaucgaagggggauggaccggcaugguggaugggugguauggauaccaucaccagaacgaacaaggcagcggcuaugcugcggaccagaaauccacacagaaugccaucaacgggauuacgaauaaggugaacagcgucaucgagaaaaugaauacccaguuuacagcugugggaaaggaguucaacaagcuggaaaaacggauggagaaccucaauaagaaaguugaugacggcuuucuggacauuuggaccuacaacgccgaacuucuggugcuccuggagaaugaaagaacacuugauuuccaugacucuaacgucaagaaucuguacgagaaagugaagaaccaacuccgcaauaacgccaaggagaucgggaauggaugcuucgaauuuuaucacaaaugugauaacgagugcauggaauccguuaagaauggcaccuacgacuaucccaaauacagcgaggagucuaagcugaaccgggagaaaauugauggggugaagcuggaguccaugggcgucuaucagauccucgcuaucuacagcacgguggccuccucucugguccuucuggugagccucggagcgauuuccuucuggaugugcucuaauggcagccugcaguguagaaucugcauuuga

SEQ ID NO: 184701 - RNA, 1698 nt, Artificial Sequence; identical to SEQ ID NO: 183766
  derived and/or modified sequence opt5 from hemagglutinin__InfluenzaA__ABR15885

SEQ ID NO: 184702 - RNA, 1698 nt, Artificial Sequence
  derived and/or modified sequence opt5 from hemagglutinin__InfluenzaA__ABR15896
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaagccccgaaucccgagaacggcaccuguuauccuggguacuuugcugacuaugaggaacugagagagcaacucuccucugugagcuccuucgaacgguuugagaucuuccccaaggagagcucuuggccuaaucauacggucaccggaguguccgccagcugcucucacaacggcaaguccagcuuuuaccgcaaucugcuuuggcugacaggcaaaaacgggcucuaucccaaucugucuauguccuacguuaacaauaaggaaaaagaggugcugguccucuggggagugcaucacccuccgaacaucggcgaucagagagcucuguaccacaccgaaaacgccuaugugagcgucguuuccucucauuacagccggcgcuucacacccgagauugcgaagagaccuaaagugcgggaccaggaagggcgcaucaauuauuacuggacccuucuggagcccggagauacgauuaucuuugaggccaacggcaaucucauugcuccuugguaugccuucgcucuguccagaggguuuggaagcggcaucauuacaucuaacgcccccauggacgaaugugaugcgaagugccagaccccgcaaggcgccaucaauuccagccuuccuuuccagaacgugcaccccgucacaaucggggaguguccuaaguacgugcggucugcuaaacugcgcaugguuaccggacucagaaauauucccagcauccagucccggggccuguuuggggccauugcuggauucaucgaaggcggguggaccggaaugguggacggcugguauggcuaccaucaccagaacgagcaagggucuggauacgccgccgaucaaaagagcacacagaaugcuauuaacggcaucacgaauaaagucaacuccgugaucgaaaagaugaauacccaguuuacagcgguugggaaagaguucaacaagcuggagcgcagaauggaaaaucucaacaaaaagguggacgauggauuccuggacauuuggaccuauaacgccgagcuucugguccuccuggaaaaugagcggacacuugacuuucacgauagcaacgugaagaaucuguacgaaaaagucaagucucagcucaaaaacaaugcuaaggagaucggcaacgggugcuucgaguuuuaucauaaauguaauaacgaaugcauggaguccgugaagaauggcaccuacgacuaucccaaguacagcgaagagucuaaacugaaccgcgagaagauugauggaguuaaacuggaauccaugggcguguaucagauccucgccauuuacagcacggucgccuccucucuggugcuucugguuagccucggggcuaucuccuucuggaugugcucuaauggaagccugcaguguagaaucugcauuuga

SEQ ID NO: 184703 - RNA, 1698 nt, Artificial Sequence; identical to SEQ ID NO: 183765
  derived and/or modified sequence opt5 from hemagglutinin__InfluenzaA__ABR15907

SEQ ID NO: 184704 - RNA, 1698 nt, Artificial Sequence; identical to SEQ ID NO: 183766
  derived and/or modified sequence opt5 from hemagglutinin__InfluenzaA__ABR15918

SEQ ID NO: 184705 - RNA, 1701 nt, Artificial Sequence
  derived and/or modified sequence opt5 from hemagglutinin__InfluenzaA__ABR15929
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagagggauuuccagccggaucucuauuuacuggaccaucgucaaaccuggagacauccugcucauuaacuccacaggcaaucugaucgcuccccgcggguauuucaagauuagaagcggaaagucuagcaucaugcgguccgacgccccuauuggcaaauguaacucugaaugcaucacccccaauggcagcaucccgaacgauaagccuuuucagaauguuaaccgcauuaccuacgggcccuguccuagauaugugaaacagaauacacuuaagcuggcuacgggaaugcggaacgugcccgagaaacaaacccgcggcaucuucggggccauugcgggauuuaucgaaaauggcugggaggggaugauggacggaugguacggcuucagacaccagaacuccgagggcacagggcaggccgcugaucucaagagcacccaagccgcuauuaaucagaucaacggaaaacugaaucggcuuaucgaaaagacaaacgagaaguuucaucagauugaaaaagaguucucugaagucgagggcagaauccaggaccuggagaaguauguggaagauaccaaaauugaccucugguccuacaaugccgagcugcugguugcccucgaaaaccaacacacgaucgaucugacagacagcgagaugaacaaacuuuucgaacgcaccaagaagcagcugcgggagaaugcugaggauauggggaacggaugcuuuaagauuuaucauaaauguaauaacgcgugcaucggcucuauuagaaaugggaccuacgaccacgauguguaccgcgacgaagcccucaacaaucgguuccagaucaagggcgucgagcugaaauccggauauaaggacuggauccuuuggauuagcuuugcuaucuccugcuuccugcucuguauugugcugcugggcuuuaucaugugggccugccagaaagggaacauuagauguaauaucugcaucuga

SEQ ID NO: 184706 - RNA, 1701 nt, Artificial Sequence
  derived and/or modified sequence opt5 from hemagglutinin__InfluenzaA__ABR15940
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucuccaacgauaagccguuucagaaugugaaccgcaucaccuacggggcuuguccuagauaugugaaacagaauacacuuaagcuggccacgggaaugcggaacguccccgagaaacaaacccgcggcauuuucggggcgaucgccggauuuauugaaaauggcugggaggggaugauggacggaugguacggcuucagacaccagaacagcgagggcacagggcaggcugccgaucucaagucuacccaagcugccaucaaucagauuaacggaaaacugaaucggcuuaucgaaaagacaaacgagaaguuucaucagaucgaaaaagaguucuccgaaguggagggccgcauucaggaccuggagaaguauguugaagauaccaaaaucgaccucuggagcuacaaugccgagcugcugguggcucucgaaaaccaacacacgauugaucugacagacucugagaugaacaaacuuuucgaaagaaccaagaagcagcugcgggagaaugcggaggauauggggaacggaugcuuuaagaucuaucauaaaugugacaaugccugcauuggcuccaucagaaacgggaccuacgaucacgacgucuaccgcgacgaagcucucaauaaccgguuccagauuaagggcguggagcugaaaagcggauauaaggauuggguucuuuggaucuccuuugccaucucuugcuuccugcucuguauugugcugcugggcuuuaucaugugggccugccagaaagggaauauuagauguaacaucugcauuuga

SEQ ID NO: 184707 - RNA, 1701 nt, Artificial Sequence; identical to SEQ ID NO: 183586
  derived and/or modified sequence opt5 from hemagglutinin__InfluenzaA__ABR15951

SEQ ID NO: 184708 - RNA, 1701 nt, Artificial Sequence
  derived and/or modified sequence opt5 from hemagglutinin__InfluenzaA__ABR15962
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagccgcgccuauuccaauuguuacccuuaugacgugcccgauuacguuucucugagaagccuuguggcuuccagcgggacgcuggaauuuaacaaugagucuuucaacuggaccggagucgcccaaaauggcacauccagcgcuugcaagcggcgcucugacaaauccuuuuucagcagacucaacuggcugcaccagcuuaaguauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugcgcggggucuccagcauuaucucuauuuacuggaccaucguuaagccuggagacauccugcucauuaacuccacaggcaaucugaucgcuccccggggguauuucaaaauuagaagcggaaagucuagcaucaugcgguccgacgccccuauuggcaaguguaacucugaaugcaucacccccaauggcagcaucccgaacgauaaaccuuuucagaaugugaaccgcauuaccuacgggcccuguccuagauaugugaagcagaauacacuuaaacuggcuacgggaaugcggaacguccccgagaagcaaacccgcggcaucuucggggccauugcgggauuuaucgaaaauggcugggaggggaugauggacggaugguacggcuucagacaccagaacuccgagggcacagggcaggccgcugaucucaaaagcacccaagccgcuauuaaucagaucaacggaaagcugaaucggcuuaucgagaaaacaaacgaaaaguuucaucagauugaaaaggaguucucugaaguggagggcagaauccaggaccuggagaaauauguugaagauaccaagauugaccucugguccuacaaugccgagcugcugguggcccucgaaaaccaacacacgaucgaucugacagacagcgagaugaacaaacuuuucgaacgcaccaagaaacagcugcgggagaaugcugaggauauggggaacggaugcuuuaagauuuaucauaagugugacaaugcgugcaucggcucuauuagaaacgggaccuacgaucacgacgucuaccgcgacgaagcccucaauaaccgguuccagaucaaaggcguggagcugaaguccggauauaaagauuggauccuuuggauuagcuuugcuaucuccugcuuccugcucuguauuguucugcugggcuuuaucaugugggccugccagaaggggaauauuagauguaacaucugcaucuga

SEQ ID NO: 184709 - RNA, 1701 nt, Artificial Sequence
  derived and/or modified sequence opt5 from hemagglutinin__InfluenzaA__ABR22241
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaaguccuuuuucagccgccucaacuggcugcaccagcuugaguauagauacccugcccugaaugugaccaugcccaacaaugacaaguuugauaaacucuauaucuggggcguccaucacccuucuacagacuccgaucagauuagcguguacgcucaggccuccgggcggguuaccgugucuacgaagcgcagccaacagacagucaucccgaacauuggauccagacccugggugcggggcaucagcucucgcauuuccaucuacuggaccaucgugaaaccuggggacauucugcugaucaacagcacaggaaaucucauugcucccagaggcuauuucaagauccggucugggaaaagcuccauuaugcgcucugacgccccuaucggaaaguguaacagcgaaugcaucacccccaauggcuccauuccgaacgauaagccuuuucagaaugucaacagaaucaccuacggcgcguguccccgguauguuaaacagaauacacugaaacuugccacggggaugcgcaacgugccugagaaacaaaccagaggaauuuucggcgcuaucgccggguuuauugaaaauggaugggagggcaugauggacgggugguacggauuccggcaccagaacagcgagggcacaggccaggcugccgaucugaagucuacccaagccgcuaucaaucagaucaacgggaaacucaauaagcugauugaaaagacaaacgagaaguuucaucagaucgaaaaggaguucuccgaaguggagggacgcauucaggaccuugagaaauaugucgaagauaccaagaucgaccuguggagcuacaaugcggagcuccugguggcccuggaaaaccaaaacacgauugaucucacagacucugagaugaauaaacuguucgaaagaacccggaagcagcuuagagagaacgcugaggauaugggcaaugggugcuuuaaaaucuaucacaagugugacaacgccugcauuggauccauccgcaauggcaccuacgaucaugacguuuaccgggacgaagcccugaacaauagauuccagaucaaggggguggagcucaaaagcggcuauaaggauuggauucuguggaucuccuuugcuauuucuugcuuccuucugugugucgugcuccugggauuuaucaugugggccugccagaaaggcaacauucgcuguaauaucugcaucuga

SEQ ID NO: 184710 - RNA, 1701 nt, Artificial Sequence; identical to SEQ ID NO: 183674
  derived and/or modified sequence opt5 from hemagglutinin__InfluenzaA__ABR28515

SEQ ID NO: 184711 - RNA, 1701 nt, Artificial Sequence
  derived and/or modified sequence opt5 from hemagglutinin__InfluenzaA__ABR28592
augaagaccaucauugcccugagcuacguguucugccucgucuuugcucaggaccugcccggcaacgauaauuccacagccacgcuuugucuggggcaccaugcgguuccuaacggaacccucgugaaaacaaucaccaaugaccaaauugaggugacaaacgcuaccgaacugguccagucuagcuccacaggcaagaucugcgauaauccgcaccggauucuugacgggaucaacuguacccugaucgaugcccuccugggagacccccauugcgauggcuuccagaaugagaaaugggaccuguuuguggaaagaucuaaggccuucagcaacuguuauccuuacgauguucccgacuaugcuucccuccgcucucugguggccagcuccgggacgcuugaguuuauuaaugaaggauucaacuggaccggcgucacacagaauggcgggagcucugcuugcaaaagaggaccugauaacggcuuuuucucccggcugaauuggcucuacaagagcgggucuaccuaucccgugcaaaacguuacaaugccuaauaacgacaacuccgauaagcuguacaucuggggagugcaccauccgagcaccgacaaagagcagacggaccuuuauguccaggccucuggcaaggugacaguguccaccaaacgcagccagcaaacagucauucccaauguuggguccagaccuugggugcggggacugucuagccgcguguccaucuacuggaccauugucaagcccggcgauauccucgugauuaacagcaauggcaaccugaucgcgccuagaggguacuuuaaaaugcggaccggaaagucuuccaucaugcgcagcgacgcccccauuggcacauguucuagcgagugcaucacgccgaauggguccauuccuaacgauaagcccuuccagaauguuaacaaaaucaccuauggagcuuguccuaaguacgugaaacagaauacacugaagcucgccaccggcaugagaaacguccccgaaaaacagacacgggggauuuuuggagcuaucgccggcuucaucgagaauggcugggaagggaugauugacggaugguauggcuuucgccaccaaaacucugaggggaccggacaggcggccgaucuuaagagcacgcaggcugccaucgaccaaauuaauggcaaacugaacagagugaucgagaagacaaaugaaaaguuccaccagauugagaaagaguucuccgaaguugaagggcggauccaggaucuggagaaguacguggaggacaccaaaaucgaucucuggagcuauaacgcugaacugcuugucgcccuggagaaccagcauaccauugaccucacagauucugaaaugaauaagcuguuugagaaaacccgcagacaacugcgggaaaacgccgaggacaugggcaauggaugcuucaagaucuaccacaagugugacaacgcuugcauuggcuccaucagaaaugggacauaugaucaugacguguaccgcgaugaggcgcucaacaaucgguuucagauuaaaggagucgaacuuaagagcggcuacaaagacuggauccuguggauuucuuucgccaucuccugcuuucugcucugugugguucugcuuggguucaucaugugggcuugccagaagggaaacauuagauguaauaucugcauuuga

SEQ ID NO: 184712 - RNA, 1698 nt, Artificial Sequence; identical to SEQ ID NO: 183766
  derived and/or modified sequence opt5 from hemagglutinin__InfluenzaA__ABR28768

SEQ ID NO: 184713 - RNA, 1698 nt, Artificial Sequence; identical to SEQ ID NO: 183766
  derived and/or modified sequence opt5 from hemagglutinin__InfluenzaA__ABR28779

SEQ ID NO: 184714 - RNA, 1701 nt, Artificial Sequence; identical to SEQ ID NO: 184457
  derived and/or modified sequence opt5 from hemagglutinin__InfluenzaA__ABR28790

SEQ ID NO: 184715 - RNA, 1698 nt, Artificial Sequence; identical to SEQ ID NO: 183766
  derived and/or modified sequence opt5 from hemagglutinin__InfluenzaA__ABR28801

SEQ ID NO: 184716 - RNA, 1701 nt, Artificial Sequence; identical to SEQ ID NO: 183674
  derived and/or modified sequence opt5 from hemagglutinin__InfluenzaA__ABR28812

SEQ ID NO: 184717 - RNA, 1701 nt, Artificial Sequence
  derived and/or modified sequence opt5 from hemagglutinin__InfluenzaA__ABR28823
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagagggauuuccagccggaucucuauuuacuggaccaucgucaaaccuggagacauccugcucauuaacuccacaggcaaucugaucgcuccccgcggguauuucaagauuagaagcggaaagucuagcaucaugcgguccgacgccccuauuggcaaauguaacucugaaugcaucacccccaauggcagcaucccgaacgauaagccuuuucagaauguuaaccgcauuaccuacgggcccuguccuagauaugugaaacagaauacacuuaagcuggcuacgggaaugcggaacgugcccgagaaacaaacccgcggcaucuucggggccauugcgggauuuaucgaaaauggcugggaggggaugauggacggaugguacggcuucagacaccagaacuccgagggcacagggcaggccgcugaucucaagagcacccaagccgcuauuaaucagaucaacggaaaacugaaucggcuuaucgaaaagacaaacgagaaguuucaucagauugaaaaagaguucucugaagucgagggcagaauccaggaccuggagaaguauguggaagauaccaaaauugaccucugguccuacaaugccgagcugcugguugcccucgaaaaccaacacacgaucgaucugacagacagcgagaugaacaaacuuuucgaacgcaccaagaagcagcugcgggagaaugcugaggauauggggaacggaugcuuuaagauuuaucauaaaugugacaaugcgugcaucggcucuauuagaaacgggaccuacgaucacgacguguaccgcgacgaagcccucaauaaccgguuccagaucaagggcgucgagcugaaauccggauauaaggauuggauccuuuggauuagcuuugcuaucuccugcuuccugcucuguauugugcugcugggcuuuaucaugugggccugccagaaagggaauauuagauguaacaucugcaucuga

SEQ ID NO: 184718 - RNA, 1698 nt, Artificial Sequence; identical to SEQ ID NO: 183894
  derived and/or modified sequence opt5 from hemagglutinin__InfluenzaA__ABR28834

SEQ ID NO: 184719 - RNA, 1698 nt, Artificial Sequence; identical to SEQ ID NO: 183865
  derived and/or modified sequence opt5 from hemagglutinin__InfluenzaA__ABR28845

SEQ ID NO: 184720 - RNA, 1701 nt, Artificial Sequence
  derived and/or modified sequence opt5 from hemagglutinin__InfluenzaA__ABR28856
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugauuaugcccaacaaugagaaguuugauaaacucuauaucuggggcguucaucacccugggaccgacucugaucagauuucccuguacgcgcaggccagcggaagagugacagucuccaccaagcggucucaacagacggugaucccgaacauuggcagccgccccugggugagaggggucuccagccggaucucuauuuacuggacaaucguuaaaccuggagacauccugcucauuaacuccaccggcaaucugaucgcuccccgcggguauuucaagauuagaagcggaaagucuagcaucaugcgguccgacgccccuauuggcaaauguaacucugaaugcaucacacccaauggcagcaucccgaacgauaagccuuuucagaaugugaaccgcauuaccuacggggcuugucccagauaugugaaacagaagacccuuaaacuggccacaggaaugcggaaugucccugagaagcaaacgcgcggcaucuucggggcgauugccggauuuaucgaaaacggcugggaggggaugauggacggaugguacggcuucagacaccaaaauuccgagggcaccgggcaggcugccgaucucaaaagcacacaggcugccauuaaccagaucaauggaaagcugaaccggcuuaucgaaaagaccaaugagaaauuucaucagauugaaaaggaguucucugaaguggagggcagaauccaggaccuggagaaauauguugaagauacaaagauugaccucugguccuacaacgccgagcugcugguggcucucgaaaaucaacacaccaucgaucugacggacagcgagaugaacaaacuuuucgaacgcacaaagaagcagcugcgggagaacgcggaggauauggggaauggaugcuuuaaaauuuaucauaagugugacaacgccugcaucggcucuauuagaaaugggaccuacgaucacgacgucuaccgcgacgaagcucucaacaaucgguuccagaucaaaggcguggagcugaaguccggauauaaagauuggauccuuuggauuagcuuugccaucuccugcuuccugcucuguauuguucugcugggcuuuaucaugugggccugccagaaggggaacauuagauguaauaucugcaucuga

SEQ ID NO: 184721 - RNA, 1701 nt, Artificial Sequence; identical to SEQ ID NO: 183631
  derived and/or modified sequence opt5 from hemagglutinin__InfluenzaA__ABR28867

SEQ ID NO: 184722 - RNA, 1701 nt, Artificial Sequence; identical to SEQ ID NO: 183586
  derived and/or modified sequence opt5 from hemagglutinin__InfluenzaA__ABR28878

SEQ ID NO: 184723 - RNA, 1698 nt, Artificial Sequence; identical to SEQ ID NO: 184228
  derived and/or modified sequence opt5 from hemagglutinin__InfluenzaA__ABR28900

SEQ ID NO: 184724 - RNA, 1701 nt, Artificial Sequence
  derived and/or modified sequence opt5 from hemagglutinin__InfluenzaA__ABR28922
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggguguccaucuacuggaccaucgugaaacccggagacauucugcugaucaauagcaccggcaaccucauugcuccucgcggguacuuuaagaucagaucuggaaaguccagcauuaugcggucugacgcccccaucggcaaauguaauagcgagugcaucacaccgaacggcuccauuccuaaugauaagcccuuccagaacgucaaucgcaucacguauggggcuuguccuagauacguuaaacagaacacccugaagcuggccacaggaaugcggaaugugcccgaaaaacaaacccgcggcauuuuuggggcgaucgccggauucauugagaacggcugggaagggaugguggacggaugguauggcuuuagacaccaaaauucugagggcaucgggcaggcugccgaucuuaagagcacacaggcugccaucaaccagauuaauggaaaacucaaccggcugaucggcaagaccaacgagaaguuccaccagauugaaaaagaguucuccgaagucgaggggagaauccaggaccuugaaaaguacguggaggauacgaaaauugaccuguggagcuauaaugccgagcuccugguugcucuggaaaaccaacauacaaucgaucucaccgacucugagaugaauaagcuguuugaacgcaccaaaaagcagcuucgggagaacgcggaagauaugggaaauggcugcuucaagauuuaccacaaaugugacaacgccugcaucggguccaucagaaauggcacauaugaucaugacguguaccgcgacgaggcucugaacaaucgguuucagauuaagggagucgagcucaaaagcggcuacaaggauuggauccuguggauuucuuucgccaucuccugcuuucuucuguguguggcccuccugggguucauuaugugggcuugccagaaaggaaacaucagauguaauaucugcauuuga

SEQ ID NO: 184725 - RNA, 1701 nt, Artificial Sequence; identical to SEQ ID NO: 184605
  derived and/or modified sequence opt5 from hemagglutinin__InfluenzaA__ABR88080

SEQ ID NO: 184726 - RNA, 1701 nt, Artificial Sequence
  derived and/or modified sequence opt5 from hemagglutinin__InfluenzaA__ABS00315
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcguggccggguggauucugggaaacccugagugcgaaucccucuuuucuaaaaagagcugguccuauaucgcugagacacccaauucugaaaacggcaccuguuaccccggguauuucgccgauuacgaggagcugcgggaacaacuuagcuccguuagcucuuuugagcgcuucgaaauuuuuccuaaggaguccagcuggcccaaucauacggugaccaaaggagucucugcuuccugcagccacaagggcagaucuuccuucuaucggaaccugcucuggcugacagagaaaaauggcagcuacccuaaccuuuccaagucuuaugugaauaacaaagaacgcgagguucuggugcucuggggaguccaucaccccagcaauaucggggaacagagagccaucuaccacaccgagaacgcguacguguccguggucagcucucauuauaaccggcgcuuuacaccugaaauugccaagagaccgaagguucggggccaggaggggcgcaucaauuacuauuggacccugcuggagcccggagacacgauuaucuucgaagcuaacggcaaucucauugccccuugguacgcuuuugcccuguccagaggguucggaagcggcaucauuacaucuaacgcgagcauggaugagugugacgccaaaugccagacaccccaaggcgcuaucaauuccucucuuccuuuucagaacgugcaccccgugaccaucggggaauguccgaaguauguccggagcaccaaacugcgcauggugaccggacucagaaauauuccuuccauccagagccggggccuguucggggccauugcuggauuuaucgagggcggguggacaggaaugauugauggcugguacggcuaucaucaccagaacgaacaagggucuggauacgccgccgaccagaaguccacgcagaaugcuaucaacggcaucaccaauaaaguuaacagcgugauugagaagaugaauacacaguucaccgcggucgggaaagaguucaacaaacuugaacgcagaauggagaaucugaacaagaagguggaugacggauuucucgauaucuggacauacaacgccgaacugcugguucuccuggagaaugaacggacccuugacuuccacgacucuaacgugaagaaucuguaugagaaagucaagucccaacucaaaaacaaugcuaaggagauuggcaacgggugcuuugaguucuaccauaaguguaauaacgaaugcauggaaagcgugaaaaauggcacguaugauuaccccaaguauuccgaggagucuaaacugaacagagaaaagaucgacggagucaaacuugagagcaugggcguguaccagauucuggccaucuauuccacaguugccucuagccucgugcugcuggucucccucggggcuaucagcuuuuggaugugcucuaauggaucccugcagugucgcauuugcaucuga

SEQ ID NO: 184727 - RNA, 1701 nt, Artificial Sequence
  derived and/or modified sequence opt5 from hemagglutinin__InfluenzaA__ABS00326
augaaggccaagcugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcguggccggguggauucugggaaacccugagugcgaaucccucuuuucuaaaaagagcugguccuauaucgcugagacacccaauucugaaaacggcaccuguuaccccggguauuucgccgauuacgaggagcugcgggaacaacuuagcuccguuagcucuuuugagcgcuucgaaauuuuuccuaaggaguccagcuggcccaaucauacggugaccaaaggagucucugcuuccugcagccacaagggcagaucuuccuucuaucggaaccugcucuggcugacagagaaaaauggcagcuacccuaaccuuuccaagucuuaugugaauaacaaagaaaaggagguucuggugcucuggggaguccaucaccccagcaauaucggggaacagcgcgccaucuaccacaccgagaacgcguacguguccguggucagcucucauuauaacagacgguuuacaccugaaauugccaagcgcccgaaaguuagaggccaggaggggcggaucaauuacuauuggacccugcuggagcccggagacacgauuaucuucgaagcuaacggcaaucucauugccccuugguacgcuuuugcccugucccgcggguucggaagcggcaucauuacaucuaacgcgagcauggaugagugugacgccaagugccagacaccccaaggcgcuaucaauuccucucuuccuuuucagaacgugcaccccgugaccaucggggaauguccgaaauaugucagaagcaccaagcugcggauggugaccggacuccgcaauauuccuuccauccagagcagaggccuguucggggccauugcuggauuuaucgagggcggguggacaggaaugauugauggcugguacggcuaucaucaccagaacgaacaagggucuggauacgccgccgaccagaaauccacgcagaaugcuaucaacggcaucaccaauaagguuaacagcgugauugagaaaaugaauacacaguucaccgcggucgggaaggaguucaacaaacuugaacggcgcauggagaaucugaacaaaaagguggaugacggauuucucgauaucuggacauacaacgccgaacugcugguucuccuggagaaugaaagaacccuugacuuccacgacucuaacgugaaaaaucuguaugagaaggucaaaucccaacucaagaacaaugcuaaggagauuggcaacgggugcuuugaguucuaccauaaauguaauaacgaaugcauggaaagcgugaagaauggcacguaugauuaccccaaauauuccgaggagucuaagcugaaccgggaaaagaucgacggagucaaacuugagagcaugggcguguaccagauucuggccaucuauuccacaguugccucuagccucgugcugcuggucucccucggggcuaucagcuuuuggaugugcucuaauggaucccugcaguguagaauuugcaucuga

SEQ ID NO: 184728 - RNA, 1701 nt, Artificial Sequence; identical to SEQ ID NO: 184664
  derived and/or modified sequence opt5 from hemagglutinin__InfluenzaA__ABS49899

SEQ ID NO: 184729 - RNA, 1701 nt, Artificial Sequence
  derived and/or modified sequence opt5 from hemagglutinin__InfluenzaA__ABS49910
augaagaccaucauugcccugagcuacaucuucugccucgcucugggccaggaccuucccgggaacgauaauuccacagccacgcugugucucggacaccaugcggugccuaacggcacccuggucaaaacaauuaccaaugaccaaaucgagguuacaaacgcuaccgaacuugugcagucuagcuccacagggaagauuugcaauaacccgcacagaauccuggauggaaucaauuguacccucauugacgcccugcugggcgauccccauugcgacguguuucaggaugagacgugggaccucuucgucgaacggucuaaagccuuuagcaacuguuauccuuacgaugugcccgacuaugcuucccugcgcucucuuguugccagcuccgggacccuggaguucaucacagaaggauuuaccuggacaggcgugacccagaauggcgggagcaacgcuugcaagagaggaccuggcucuggguucuuuucccggcucaauuggcugacgaaaagcggaucuacauaccccguccuuaacgugaccaugccuaauaacgauaauuucgacaagcuguauauuuggggcguucaccauccguccacaaaccaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgauguucuggugauuaauagcaacgggaaucucaucgcgccucgcggauacuuuaaaaugagaacaggcaagucuuccauuaugcggagcgacgcccccaucgacaccuguauuucugagugcaucacaccgaacgggagcaucccuaaugauaaacccuuccagaacgugaauaagauuaccuacggagcuuguccuaaauaugucaagcagaacacgcugaaacuugccacaggcaugcgcaaugugcccgaaaagcagaccagagggcuguuuggagcuaucgccggcuucauugagaacggcugggaagggaugaucgacggaugguacggcuuucggcaccaaaauuccgaggggaccggacaggcggccgaucucaagucuacacaggcugccauugaccaaaucaacggcaaacugaaucgcguuaucgagaagaccaacgaaaaauuccaccagauugagaaggaguucagcgaaguggaagggagaauccaggaucuugagaaauaugucgaggacacaaagauugaucugugguccuacaaugcugaacuccugguggcccuggagaaccagcauacgaucgaccucaccgauagcgaaaugaacaagcuguuugagaaaacacggagacaaaugcgcgaaaaugccgaggacaugggcaacggaugcuucaagauuuaucacaaaugugauaaugcuugcaucgagucuauucggaacggcaccuacgaccaugacguuuauagagaugaagcgcuuaauaaccgcuuucagaucaaggggguggagcugaaauccggauacaaggacuggauccucuggauuagcuucgccaucucuugcuuucugcuuugugucgugcugcucggcuucauuaugugggcuugccagcgggggaauaucagauguaacauuugcaucuga

SEQ ID NO: 184730 - RNA, 1701 nt, Artificial Sequence; identical to SEQ ID NO: 183674
  derived and/or modified sequence opt5 from hemagglutinin__InfluenzaA__ABS49965

SEQ ID NO: 184731 - RNA, 1698 nt, Artificial Sequence
  derived and/or modified sequence opt5 from hemagglutinin__InfluenzaA__ABS49976
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuagauaugcuuucgcccugucccggggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcgcucugccaagcugagaaugguuaccggacuccggaacauucccagcauccagucccgcggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagagacggauggaaaaccucaacaagaagguggaugacggauuccuggauauuuggacauauaaugcggagcuucugguccuccuggaaaacgagcgcacccuugacuuucacaauagcaacgugaaaaaucuguacgaaaaggucaaaucucaacucaagaacaaugccaaagagaucggcaacgggugcuucgaguuuuaucauaaguguaauaacgaaugcauggaguccgugaagaauggcacguacgacuaucccaaauacagcgaagagucuaagcugaacagagagaaaauugauggaguuaagcuggaauccaugggcguguaucagauccucgcuauuuacagcacagucgccuccucucuggugcuucugguuagccucggggccaucuccuucuggaugugcucuaauggaagccugcagugucggaucugcauuuga

SEQ ID NO: 184732 - RNA, 1698 nt, Artificial Sequence
  derived and/or modified sequence opt5 from hemagglutinin__InfluenzaA__ABS49987
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaaugguuaccggacuccggaauauucccagcauccagucccgcggccuguuuggggcuauugccggauucaucgaaggcggguggacaggaaugguggacggcugguauggcuaccaucaccagaacgagcaagggucuggauacgcugccgaucagaaaagcacgcagaaugccauuaacggcaucaccaauaaggucaacuccgugaucgaaaagaugaauacacaguuuaccgcuguugggaaagaguucaacaaacuggagagacggauggaaaaucucaacaagaagguggacgauggauuccuggacauuuggacauauaacgcggagcuucugguccuccuggaaaaugagcgcacccuugacuuucacgauagcaacaugaaaaaucuguacgaaaaggugaaaucucaacucaagaacaaugccaaagagaucggcaacgggugcuucgaguuuuaucauaaguguaauaacgaaugcauggaguccgucaagaauggcacguacgacuaucccaaauacagcgaagagucuaagcugaacagagagaaaauugauggagugaagcuggaauccaugggcguuuaucagauccucgcuauuuacagcacaguggccuccucucugguccuucuggugagccucggggccaucuccuucuggaugugcucuaauggaagccugcagugucggaucugcauuuga

SEQ ID NO: 184733 - RNA, 1701 nt, Artificial Sequence
  derived and/or modified sequence opt5 from hemagglutinin__InfluenzaA__ABS49998
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucauuaugcccaauaacgagaaguuugacaaacucuauaucuggggagugcaucacccuucuaccgauuccgaccagauuagccuguacgcccaggcuccggggcgcguuacaguguccaccaagagaucucaacagacggucauccccaacauuggcagccggccuugggugcgcgggguguccagcagaaucucuauuuacuggacaaucgucaaacccggagauauccugcucauuaauuguaccggcaaccugaucgccccucggggguauuucaagauucgcuccggaaagagcucuaucaugagaagcgacgcuuccauuggcaaaugcaauucugaauguaucacacccaacggcagcaucccgaaugacaagccuuuucagaacguuaaucggauuaccuacggggccugcccccgcuaugugaaacagaacacccuuaagcuggcgacaggaaugagaaaugugccugagaaacaaacgcggggcaucuucggggccauugcuggauuuaucgaaaacggcugggaggggauggucgauggaugguacggcuuccgccaccaaaauuccgagggcaccgggcaggccgcugaccucaagagcacacaggccgccauuaaccagaucaauggaaaacugaacagacuuaucgaaaagaccaaugagaaguuucaucagauugaaaaagaguucucugaaguggagggccggauccaggaucuggagaaguauguugaagacacaaaaauugaucucugguccuacaacgcugagcugcugguggcgcucgaaaaccaacacaccaucgaccugacggauagcgagaugaauaaacuuuucgaaagaacaaagaagcagcugcgcgagaacgccgaggacauggggaauggauguuuuaagauuuaucauaaaugcgauaacgcuugcaucggcucuauucggaaugggaccuacgaccacgaugucuacagagacgaagcccucaacaaucgcuuccagaucaagggcguggagcugaaauccggauauaaggacuggauccuuuggauuagcuuugccaucuccuguuuccugcucugcguugugcugcugggcuuuauuaugugggcuugucagaaagggaacauccggugcaauauuuguaucuga

SEQ ID NO: 184734 - RNA, 1701 nt, Artificial Sequence
  derived and/or modified sequence opt5 from hemagglutinin__InfluenzaA__ABS50009
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacgcuggaauuuaacaaugagucuuucaacuggaccggcguggcucaaaauggcacauccagcgccugcaaacgcagaucuaacaaguccuuuuucagccggcucaauuggcugcaccagcuuaaguauaaauacccugcgcugaacgucaccaugcccaauaacgagaaguuugacaaacucuauauuuggggagugcaucacccuucuacagauuccgaccagaucagccuguacgcccaggcuccggggcgcguuaccguguccacgaagagaucucaacagacagucauucccaacaucggcagccggccuugggugcgcgggguguccagcaaaauuucuaucuacuggaccauugucaagcccggagauauccugcucaucaauuguacaggcaaccugauugccccuagaggguauuucaagauccgguccggaaaaagcucuauuaugcgcagcgacgcuuccaucggcaagugcaauucugaauguauuacccccaacggcagcaucccgaaugacaaaccuuuucagaacguuaauagaaucaccuacggggccugcccccgguaugugaagcagaacacacuuaaacuggcgacgggaaugcgcaaugugccugagaagcaaaccagaggcauuuucggggccaucgcuggauuuauugaaaacggcugggaggggauggucgauggaugguacggcuuccggcaccaaaauuccgagggcacagggcaggccgcugaccucaaaagcacccaggccgccaucaaccagauuaauggaaagcugaaccgccuuaucgaaaagacaaaugagaaauuucaucagaucgaaaaggaguucucugaaguggagggccggauucaggaucuggagaaauauguugaagacaccaagaucgaucucugguccuacaacgcugagcugcugguggcgcucgaaaaccaacacacgauugaccugacagauagcgagaugaauaaacuuuucgaaagaaccaagaagcagcugagagagaacgccgaggacauggggaauggauguuuuaaaaucuaucauaagugcgauaacgcuugcauuggcucuauccgcaaugggaccuacgaccacgaugucuaccgggacgaagcccucaacaauagauuccagauuaaaggcguggagcugaaguccggauauaaagacuggauccuuuggaucagcuuugccauuuccuguuuccugcucugcguugugcugcugggcuuuaucaugugggcuugucagaaggggaacauucgcugcaauaucuguauuuga

SEQ ID NO: 184735 - RNA, 1701 nt, Artificial Sequence; identical to SEQ ID NO: 183734
  derived and/or modified sequence opt5 from hemagglutinin__InfluenzaA__ABS50020

SEQ ID NO: 184736 - RNA, 1701 nt, Artificial Sequence
  derived and/or modified sequence opt5 from hemagglutinin__InfluenzaA__ABS50031
augaagaccaucauugcccugagcuacaugcucugccugguguucgcucagaaacuucccggcaacgacaauuccacagccaugcugugucucgggcaccaugcggucccuaacggaacgcugguuaagaccaucacaaaugaucaaauugaggugaccaacgcuacagaacuugugcagucuagcuccaccggcgggaucugcgacucuccgcaccagauucuggauggagagaauuguacacucaucgacgcccugcugggcgauccccauugcgacggguuucagaacaaagaaugggaucucuucgucgagagaagcaaggccuauuccaauuguuacccuuaugacgugcccgauuacgcuucucugcggagccuuguugccuccagcggaacccuggaauuuaacaaugagucuuucaacuggacgggcguggcucaaaauggcaccuccagcgccugcaaacgcagaucuaacaaguccuuuuucagccggcucaauuggcugcaccagcuuaaguauaaauacccugcgcugaacgucacaaugcccaauaacgagaaguuugacaaacucuauaucuggggagugcaucacccuucuaccgauuccgaccagauuagccuguacgcccaggcuccggggcgcguuacaguguccaccaagagaucucaacagacggucauccccaacauuggcagcgggccuugggugcggggaguguccagccgcaucucuauuuacuggacaaucgucaaacccggcgauauucugcucaucaauuguaccgggaaccugaucgccccuagaggauauuucaagauucgguccggcaagagcucuaucaugcgcagcgacgcuuccauuggcaaaugcaauucugaauguaucacacccaacgggagcauuccgaaugacaagccuuuucagaacguuaauagaaucaccuacggagccugcccccgguaugugaaacagaacacccuuaagcuggcgacaggcaugcgcaaugugccugagaaacaaacgagagggaucuucggagccauugcuggcuuuaucgaaaacgggugggagggaauggucgauggcugguacggcuuccggcaccaaaauuccgaggggaccggacaggccgcugaccucaagagcacacaggccgccauuaaccagaucaauggcaaacugaaccgccuuauugaaaagaccaaugagaaguuucaucagaucgaaaaagaguucucugaaguggaggggagaauccaggaucuggagaaguauguugaagacacaaaaauugaucucugguccuacaacgcugagcugcugguggcgcucgaaaaccaacacaccaucgaccugacggauagcgagaugaauaaacuuuucgaacggacaaagaagcagcugagagagaacgccgaggacaugggaaauggcuguuuuaagauuuaucauaaaugcgauaacgcuugcaucgggucuauucgcaauggcaccuacgaccacgaugucuaccgggacgaagcccucaacaauagauuccagaucaagggaguggagcugaaauccggcuauaaggacuggauucuuuggaucagcuuugccaucuccuguuuccugcucugcguugugcugcugggguuuauuaugugggcuugucagaaaggaaacauccgcugcaauauuuguaucuga

SEQ ID NO: 184737 - RNA, 1701 nt, Artificial Sequence; identical to SEQ ID NO: 183075
  derived and/or modified sequence opt5 from hemagglutinin__InfluenzaA__ABS50042

SEQ ID NO: 184738 - RNA, 1701 nt, Artificial Sequence; identical to SEQ ID NO: 184717
  derived and/or modified sequence opt5 from hemagglutinin__InfluenzaA__ABS50053

SEQ ID NO: 184739 - RNA, 1701 nt, Artificial Sequence
  derived and/or modified sequence opt5 from hemagglutinin__InfluenzaA__ABS50064
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacgggcccuguccuagauaugugaaacagacaacgcuuaagcuggcuaccggaaugcggaauguccccgagaaacaaacacgcggcauuuucggggccaucgcgggauuuauugaaaacggcugggaggggaugauggacggaugguacggcuucagacaccaaaauuccgagggcaccgggcaggccgcugaucucaagagcacacaggccgcuaucaaccagauuaauggaaaacugaaccggcuuaucgaaaagaccaaugagaaguuucaucagaucgaaaaagaguucucugaaguggagggccgcauucaggaccuggagaaguauguugaagauacgaaaaucgaccucugguccuacaacgccgagcugcuggugagccucgaaaaucaacacacaauugaucugaccgacucugagaugaacaaacuuuucgaaagaaccaagaagcagcugcgggagaacgccgaggauauggggaauggaugcuuuaagaucuaucauaaaugugacaacgcuugcauuggcuccaucagaaaugggacauacgaucacgacgucuaccgcgacgaagcgcucaacaaucgguuccagauuaagggcguggagcugaaaagcggauauaaggauuggauccuuuggaucuccuuugccauuucuugcuuccugcucuguaucguucugcugggcuuuauuaugugggcuugccagaaagggaacaucagauguaauauuugcaucuga

SEQ ID NO: 184740 - RNA, 1701 nt, Artificial Sequence
  derived and/or modified sequence opt5 from hemagglutinin__InfluenzaA__ABS50075
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcacaaaauccuugauggagagaauuguacccugauugacgcccuccugggcgauccccagugcgacggguuucagaacaagaaaugggaucuguucgucgaaagaagcaaggccuauuccaauuguuacccuuaugacgugcccgauuacgcuucucuccggagccugaucgccuccagcggaacgcuugaguuuaacaaugaaucuuucaacuggaccggcguuacacaaaauggcaccuccagcgcuugcaagcgcagaucuaacuccagcuuuuucucucggcugaauuggcucacacaucugaaauuuaaguauccugcccuuaacgugaccaugcccaauaacgaggaguucgacaaacuguacauuuggggaguccaccauccugggacguauaacgaucagaucucccucuacgcgcaggccagcggccgcauuacaguguccaccaagagaucucagcaaacaguuaucccgaauauugggagccggccccgcgugagagacaucccuucccggaucagcauuuacuggaccaucgucaaacccggagauauucugcugaucaacucuaccggcaaucucauugcuccucgcggguauuuuaagaucagauccggaaagagcucuaucaugcggagcgacgcccccauuggcaaauguaacuccgaaugcaucacaccgaauggcucuauuccuaacgacaagcccuuccagaaugugaaccgcaucacguacggggcuuguccuagauaugugaaacagaauacccugaaacuugccacaggaaugcggaacguccccgagaagcagacccgcggcauuuuuggggcgaucgccggauucaucgaaaauggcugggaggggaugguugauggaugguacggcuuuagacaccaaaacagcgagggcauugggcaggcugccgaccugaaguccacacaggcugccaucgaucaaauuaauggaaaacucaaccggcugaucggcaagaccaaugaaaaguuccaccagauugagaaagaguucagcgaaguggaagggagaauccaggaccuugagaaguauguggaggauacgaaaauugaccuguggucuuacaacgccgaacuccuggucgcucuggagaaccagcauacaaucgaucucaccgacuccgaaaugaauaagcuguuugagcgcaccaaaaagcaacuucgggaaaacgcggaggauaugggaaauggcugcuucaagaucuaucacaaaugugacaacgccugcauugggagcaucagaaauggcacauacgaucaugacguguaccgcgacgaggcucugaacaaucgguuucagauuaagggaguugaacucaaaucuggcuauaaggauuggauccuguggauuuccuucgccaucagcugcuuucuucuguguguggcccuccugggguucaucaugugggcuugccagaaaggaaacauuagauguaauaucugcauuuga

SEQ ID NO: 184741 - RNA, 1698 nt, Artificial Sequence
  derived and/or modified sequence opt5 from hemagglutinin__InfluenzaA__ABS71665
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuagagagagcugguccuacauuguggaaaaaccgucucccgagaauggcaccuguuauccugggcauuuugccgacuacgaggaacuucgggagcaacugagcuccgucagcucuuucgaacgcuuugagaucuuccccaaggaguccagcuggccuaaccacacggccaccggagugucugcuuccugcagccauaauggcgaaucuuccuuuuauaagaaccuccuguggcuuacaggcaaaaaugggcuguaccccaaccucagcaaguccuaugccaauaacaaagagaaggaaguucuggugcuguggggaguccaccacccuccgaauaucggcgaucagagagcucucuaccauaccgagaacgccuacgugucuguggucagcucccacuauagccggaaauucacacccgaaauugcgaagcgcccuaagguuagagaccaggaggggcggaucucuuacuauuggacccugcuugagcccggagauacgauuaucuuugaagccaacggcaaucugauugcuccucgcuacgccuucgcucucuccagaggguuuggaagcggcaucauuaacucuaaugcccccauggacgagugugaugcgaaaugccagacaccgcaaggcgccaucaacagcucccugccuuuccagaaugugcaucccgugaccaucggggaauguccuaaguauguccggucugcuaaacuucgcauggugacaggacugagaaacauucccagcauccagucccggggccucuuuggggccauugcuggauucaucgagggcggguggaccggaaugguugacggcugguacggcuaucaccaccagaaugaacaagggagcggauacgccgccgaucagaagucuacccagaacgcuauuaauggcaucacaaacaaagucaauuccgugaucgagaagaugaacacgcaguuuaccgcgguggggaaagaguucaauaagcuggaacgcagaauggagaaccugaauaagaaaguugacgauggauucauugacaucuggacauacaacgccgaacuccuggugcuucuggagaacgaacggacccucgacuuucaugauagcaaugucaagaaccuguaugagaaagugaagucucaacuuaaaaauaacgcuaaggagauuggcaaugggugcuucgaauuuuaccacaaguguaacgacgagugcauggaauccgucaaaaauggcacauaugauuaccccaaguauagcgaggaguccaaacugaaccgcgaaaagaucgacggagugaaacucgagucuaugggcguuuaccagauucuggccaucuauagcaccguggccuccucucugguccuccuggugagccuuggggcuaucuccuucuggaugugcagcaauggaucucugcaguguagaauuugcaucuga

SEQ ID NO: 184742 - RNA, 1698 nt, Artificial Sequence
  derived and/or modified sequence opt5 from hemagglutinin__InfluenzaA__ABS71666
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuagagagagcugguccuacauuguggaaaaaccgucucccgagaauggcaccuguuauccugggcauuuugccgacuacgaggaacuucgggagcaacugagcuccgucagcucuuucgaacgcuuugagaucuuccccaaggaguccagcuggccuaaccacacggccaccggagugucugcuuccugcagccauaauggcaagucuuccuuuuauaaaaaccuccuguggcuuacaggcaagaaugggcuguaccccaaccucagcaaauccuaugccaauaacaaggaaaaagagguucuggugcuguggggaguccaccacccuccgaauaucggcgaucagagagcucucuaccauaccgaaaacgccuacgugucuguggucagcucccacuauagccggaaguucacacccgagauugcgaagcgcccuaaaguuagagaccaggaagggcggaucucuuacuauuggacccugcuugagcccggagauacgauuaucuuugaggccaacggcaaucugauugcuccucgcuacgccuucgcucucuccagaggguuuggaagcggcaucauuaacucuaaugcccccauggacgaaugugaugcgaagugccagacaccgcaaggcgccaucaacagcucccugccuuuccagaaugugcaucccgugaccaucggggaguguccuaaauauguccggucugcuaaacuucgcauggugacaggacugagaaacauucccagcauccagucccggggccucuuuggggccauugcuggauucaucgaaggcggguggaccggaaugguugacggcugguacggcuaucaccaccagaaugagcaagggagcggauacgccgccgaucagaaaucuacccagaacgcuauuaauggcaucacaaacaaggucaauuccgugaucgaaaagaugaacacgcaguuuaccgcgguggggaaggaguucaauaagcuggagcgcagaauggaaaaccugaauaaaaagguugacgauggauucauugacaucuggacauacaacgccgagcuccuggugcuucuggaaaacgagcggacccucgacuuucaugauagcaaugucaaaaaccuguaugaaaaggugaaaucucaacuuaagaauaacgcuaaggagauuggcaaugggugcuucgaguuuuaccacaaauguaacgacgaaugcauggaguccgucaagaauggcacauaugauuaccccaaauauagcgaagaguccaagcugaaccgcgagaaaaucgacggagugaagcucgaaucuaugggcguuuaccagauucuggccaucuauagcaccguggccuccucucugguccuccuggugagccuuggggcuaucuccuucuggaugugcagcaauggaucucugcaguguagaauuugcaucuga

SEQ ID NO: 184743 - RNA, 1698 nt, Artificial Sequence
  derived and/or modified sequence opt5 from hemagglutinin__InfluenzaA__ABS71667
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuagagagagcugguccuacauuguggaaaaaccgucucccgagaauggcaccuguuauccugggcauuuugccgacuacgaggaacuucgggagcaacugagcuccgucagcucuuucgaacgcuuugagaucuuccccaaggaguccagcuggccuaaccacacggccaccggagugucugcuuccugcagccauaauggcaagucuuccuuuuauaaaaaccuccuguggcuuacaggcaagaaugggcuguaccccaaccucagcaaauccuaugccaauaacaaggaaaaagagguucuggugcuguggggaguccaccacccuccgaauaucggcgaucagagagcucucuaccauaccgaaaacgccuacauuucuguggugagcucccacuauagccggaaguucacacccgagaucgcgaagcgcccuaaagucagagaccaggaagggcggauuucuuacuauuggacccugcuugagcccggagauacgaucauuuuugaggccaacggcaaucugaucgcuccucgcuacgccuucgcucucuccagaggguuuggaagcggcauuaucaacucuaaugcccccauggacgaaugugaugcgaagugccagacaccgcaaggcgccaucaacagcucccugccuuuccagaauguucaucccgugaccauuggggaguguccuaaauaugugcggucugcuaaacuucgcauggucacaggacugagaaacauccccagcauucagucccggggccucuuuggggccaucgcuggauucauugaaggcggguggaccggaaugguggacggcugguacggcuaucaccaccagaaugagcaagggagcggauacgccgccgaucagaaaucuacccagaacgcuaucaauggcaucacaaacaagguuaauuccgugauugaaaagaugaacacgcaguuuaccgcggucgggaaggaguucaauaagcuggagcgcagaauggaaaaccugaauaaaaagguggacgauggauucaucgacauuuggacauacaacgccgagcuccugguucuucuggaaaacgagcggacccucgacuuucaugauagcaaugugaaaaaccuguaugaaaaggucaaaucucaacuuaagaauaacgcuaaggagaucggcaaugggugcuucgaguuuuaccacaaauguaacgacgaaugcauggaguccgugaagaauggcacauaugauuaccccaaauauagcgaagaguccaagcugaaccgcgagaaaauugacggagucaagcucgaaucuaugggcguguaccagauccuggccaucuauagcaccguugccuccucucuggugcuccuggucagccuuggggcuauuuccuucuggaugugcagcaauggaucucugcaguguagaaucugcauuuga

SEQ ID NO: 184744 - RNA, 1698 nt, Artificial Sequence
  derived and/or modified sequence opt5 from hemagglutinin__InfluenzaA__ABS71668
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaaucccugaucucuagagagagcugguccuacauuguggaaaaaccgucucccgagaauggcaccuguuauccugggcauuuugccgacuacgaggaacuucgggagcaacugagcuccgucagcucuuucgaacgcuuugagaucuuccccaaggaguccagcuggccuaaccacacggccucuggaguguccgcuagcugcucucauaauggcaaguccagcuuuuauaaaaaccuccuguggcuuaccggcaagaaugggcuguaccccaaccucuccaaaucuuaugccaauaacaaggaaaaagagguucuggugcuguggggaguccaccacccuccgaauaucggcgaucagagagcucucuaccauacagaaaacgccuacgugagcguggucuccagccacuauucucggaaguucacccccgagauugcgaagcgcccuaaaguuagagaccaggaagggcggaucaacuacuauuggacacugcuugagcccggagauaccauuaucuuugaggccaauggcaaccugauugcuccucgcuacgccuucgcucucuccagaggguuuggaagcggcaucauuaauucuaacgcccccauggacgaaugugaugcgaagugccagacgccgcaaggcgccaucaauagcucccugccuuuccagaacgugcaucccgugacaaucggggaguguccuaaauauguccggucugcuaaacuucgcauggugaccggacugagaaauauucccagcauccagucccggggccucuuuggggccauugcuggauucaucgaaggcggguggacaggaaugguugacggcugguacggcuaucaccaccagaacgagcaagggagcggauacgccgccgaucagaaaucuacccagaaugcuauuaacggcaucaccaauaaggugaacuccgucaucgaaaagaugaauacacaguuuacggcgguggggaaggaguucaacaagcuggagcgcagaauggaaaaucugaacaaaaagguugacgauggauucauugacaucuggaccuacaacgccgagcuccuggugcuucuggaaaaugagcggacacucgacuuucaugauagcaacgucaaaaaucuguaugaaaaggugaaaucucaacuuaagaacaaugcuaaggagauuggcaacgggugcuucgaguuuuaccacaaauguaaugacgaaugcauggaguccgucaagaacggcaccuaugauuaccccaaauauagcgaagaguccaagcugaaucgcgagaaaaucgacggagugaagcucgaaucuaugggcguuuaccagauucuggccaucuauagcacaguggccuccucucugguccuccuggugagccuuggggcuaucuccuucuggaugugcagcaacggaucucugcaguguagaauuugcaucuga

SEQ ID NO: 184745 - RNA, 1698 nt, Artificial Sequence
  derived and/or modified sequence opt5 from hemagglutinin__InfluenzaA__ABS71669
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcgaauccagcuuuuauaaaaaucugcuuuggcugacaggcaagaacgggcucuaccccaaucugucuaaauccuaugcuaacaauaaggagaaagaagugcugguccucuggggagugcaccacccuccgaacaucggcgaucagaaggcccuguaccauaccgagaacgcuuacgugagcgucguuuccucucacuauagccgcaaguucacacccgaaauugccaaaagaccuaaggugcgggaccaggaggggcgcaucaauuacuauuggacccuucuggagcccggagauacgauuaucuuugaagcgaacggcaaucucauugccccuagauacgcuuucgcccugucccggggguuuggaagcggcaucauuaacucuaaugcucccauggacaaaugugaugccaagugccagacaccgcaaggcgcgaucaacuccagccuuccuuuccagaaugugcaucccgucaccaucggggaguguccuaaauaugugcgcucugccaagcugagaaugguuacaggacuccggaacauucccagcauccagucccgcggccuguuuggggcuauugccggauucaucgaaggcggguggaccggaaugguggacggcugguacggcuaucaccaccagaaugagcaagggucuggauacgcugccgaucagaaaagcacccagaacgccauuaauggcaucacaaacaaggucaauuccgugaucgaaaagaugaacacgcaguuuaccgcuguugggaaagaguucaauaagcuggagagacggauggaaaaccucaacaaaaagguggacgauggauucauugacaucuggacauacaaugcggagcugcuuguccugcucgaaaacgagcgcacccuggacuuucaugauagcaaugugaaaaaccuuuaugaaaaggucaagucucaacugaaaaauaacgccaaggagauuggcaaugggugcuucgaguuuuaccacaaauguaacgacgaaugcauggaguccgugaagaauggcacauaugauuaccccaaauauagcgaagagucuaagcucaacagagagaagaucgacggaguuaaacuggaauccaugggcguguaccagauucuggcuaucuauagcaccgucgccuccucucucgugcugcuuguuagccugggggccaucuccuucuggaugugcucuaauggaagccuccagugucggauuugcaucuga

SEQ ID NO: 184746 - RNA, 1698 nt, Artificial Sequence
  derived and/or modified sequence opt5 from hemagglutinin__InfluenzaA__ABS71671
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagauguuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagcgcgcccuguaccauaccgaaaacgcuuacgugagcgucguuuccucucacuauagcagaaaguucacacccgagaucgccaaacggccuaaggugcgcgaccaggaagggagaauuaauuacuauuggacccuucuggagcccggagauacgaucauuuuugaggcgaacggcaaucucaucgccccucgguacgcuuucgcccugucccgcggguuuggaagcggcauuaucaacucuaaugcucccauggacgaaugugaugccaaaugccagacaccgcaaggcgcgauuaacuccagccuuccuuuccagaaugugcaucccgucaccaucggggaguguccuaaguaugugagaucugccaaacugcggaugguuacaggacuccgcaacauccccagcauucaguccagaggccuguuuggggcuaucgccggauucauugaaggcggguggaccggaaugguggacggcugguacggcuaucaccaccagaaugagcaagggucuggauacgcugccgaucaaaagagcacccagaacgccaucaauggcauuacaaacaaagucaauuccgugaucgaaaagaugaacacgcaguuuaccgcuguugggaaggaguucaauaaacuggagcggcgcauggaaaaccucaacaagaaaguggacgauggauucaucgacauuuggacauacaaugcggagcugcuuguccugcucgaaaacgagagaacccuggacuuucaugauagcaaugugaagaaccuuuaugaaaaagucaagucucagcugaagaauaacgccaaagagaucggcaaugggugcuucgaguuuuaccacaaguguaacgacgaaugcauggaguccgugaaaaauggcacauaugauuaccccaaguauagcgaagagucuaaacucaaccgggagaagauugacggaguuaagcuggaauccaugggcguguaccagauccuggcuauuuauagcaccgucgccuccucucucgugcugcuuguuagccugggggccaucuccuucuggaugugcucuaauggaagccuccagugucgcaucugcauuuga

SEQ ID NO: 184747 - RNA, 1698 nt, Artificial Sequence
  derived and/or modified sequence opt5 from hemagglutinin__InfluenzaA__ABS71672
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcggcucuccucugucagcuccuucgaacgcuuugagauguuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgcccaaagagcucuguaccauaccgaaaacgccuacgugagcgucguuuccucucacuauagccggaaguucacacccgagaucgcgaaacgcccuaaggugagagaucaggaagggcggauuaauuacuauuggacccuucuggagcccggagacacgaucauuuuugaggccaacggcaaucucaucgcuccucgcuacgccuucgcucuguccagaggguuuggaagcggcauuaucaacucuaaugcccccauggaugaaugugacgcgaaaugccagacaccgcagggcgccauuaacuccagccuuccuuuccaaaaugugcaucccgucaccaucggggaguguccuaaguaugugcggucugcuaaacugcgcaugguuacaggacucagaaacauccccagcauucagucccggggccuguuuggggccaucgcuggauucauugaaggcggguggaccggaaugguggauggcugguacggcuaucaccaccagaaugagcaggggucuggauacgccgccgaccaaaagagcacccagaacgcuaucaauggcauuacaaacaaagucaauuccgugaucgaaaagaugaacacgcaguuuaccgcgguugggaaggaguucaauaaacuggagcgcagaauggaaaaccucaacaagaaaguggaugacggauucaucgauauuuggacauacaaugccgagcugcuuguccugcucgaaaacgagcggacccuggacuuucaugacagcaaugugaagaaccuuuaugaaaaagucaagucucagcugaagaauaacgcuaaagagaucggcaaugggugcuucgaguuuuaccacaaguguaacgaugaaugcauggaguccgugaaaaauggcacauaugacuaccccaaguauagcgaagagucuaaacucucccgcgagaagauugauggaguuaagcuggaaagcaugggcguguaccaaauccuggccauuuauuccaccgucgccucuagccucgugcugcuuguuucccugggggcuaucucuuucuggaugugcagcaacggaucccuccaguguagaaucugcauuuga

SEQ ID NO: 184748 - RNA, 1698 nt, Artificial Sequence
  derived and/or modified sequence opt5 from hemagglutinin__InfluenzaA__ABS71673
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggccgcuccagcuuuuacagaaaucugcuuuggcugaccggcaagaacgggcucuaucccaaucugucuaaauccuacgcuaacaauaaggaaaaagaggugcugguccucuggggagugcaucacccuccgaacaucggcgaucagcgggcccuguaccacacagaaaacaccuaugugagcgucguuuccucucauuacagccgcagauucacgcccgagauugcuaagcggccuaaagugcgcgaccaggaagggagaaucaauuauuacuggacacuucuggagcccggagauaccauuaucuuugaggccaacggcaaucucauugcgccucgguucgccuuugcucugucccgcggguucggaagcggcaucauuacaucuaacgcccccauggacgaaugugaugcuaagugccagaccccgcaaggcgccaucaauuccagccuuccuuuucagaacgugcaccccgucaccaucggggaguguccuaaguaugugagaucugcgaaacugcggauggccacaggacuccgcaauauucccagcauccaguccagaggccuguucggggcuauugccggauuuaucgaaggcggguggacgggaaugguugacggcugguacggcuaucaucaccagaacgagcaagggucuggauacgcugccgaucaaaagagcacccagaaugccauuaacggcaucacaaauaaagugaacuccgucaucgaaaagaugaauacccaguucacagcuguggggaaagaguucagcaagcuggagcggcgcauggaaaaccucaauaaaaagguugacgauggauuucuggacauuuggaccuacaacgcggagcuucuggugcuccuggaaaacgagagaacgcuugacuuccacgauucuaaugucaagaaccuguaugaaaaagugaagucccagcucaaaaauaacgccaaggagaucggcaaugggugcuuugaguucuaccauaaauguaacgacgaaugcauggagagcgucaagaauggcacauaugauuaccccaaguauucugaagaguccaaacugaaccgggagaagauugacggagugaaacuggaaagcaugggcguuuaccagauccucgcuauuuauuccaccguggccucuagccugguccuucuggugucccucggggccaucucuuuuuggaugugcagcaauggaucccugcaguguagaaucugcauuuga

SEQ ID NO: 184749 - RNA, 1701 nt, Artificial Sequence; identical to SEQ ID NO: 183654
  derived and/or modified sequence opt5 from hemagglutinin__InfluenzaA__ABS71674

SEQ ID NO: 184750 - RNA, 1701 nt, Artificial Sequence
  derived and/or modified sequence opt5 from hemagglutinin__InfluenzaA__ABS71675
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagcccauuccaauuguuauccuuacgacgugcccgauuaugcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaccugaaguuuaaauacccugcccuuaaugucaccaugcccaacaacgagaaguucgacaaacuguauaucuggggagugcaucacccugggacggauaaugaccagauuuuucucuacgcgcaggccucuggccgcaucacaguuuccaccaagagaagccaacagacagugauuccgaacaucgggucccggccccgcgucagaaauauuccuucucggaucagcaucuauuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguacggggcuuguccuagauaugucaaacagaauacccugaaacuugccacaggaaugcggaacguucccgaaaagcaaacccgcggcaucuucggggcgauugccggauuuaucgagaauggcugggaagggaugguggauggaugguacggcuucagacaccagaacuccgagggcaucgggcaggcugccgaccugaagucuacacaagcugccauuaaucagaucaacggaaaacucaaccggcugauuggcaagaccaaugagaaguuccaucagaucgaaaaagaguuuagcgaaguggaggggcgcauucaggaucuugaaaaguaugucgaggacacgaaaaucgaucugugguccuacaacgccgagcuccugguggcucuggaaaaucaacacacaauugaccucaccgauagcgagaugaacaagcuguucgaaagaaccaaaaagcagcuucgggagaaugcggaagacaugggaaacggcugcuuuaagaucuaucauaaaugugauaaugccugcaucgggucuauuagaaacggcacauacgaccacgauguuuaucgcgacgaggcucugaauaaccgguuccagaucaagggaguggagcucaaauccggcuacaaggacuggauucuguggaucagcuuugccauuucuugcuuccuucugugugucgcccuccugggguuuaucaugugggcuugccagaaaggaaauaucagauguaacauuugcaucuga

SEQ ID NO: 184751 - RNA, 1701 nt, Artificial Sequence
  derived and/or modified sequence opt5 from hemagglutinin__InfluenzaA__ABS71676
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaagcgcgggagcaacaauagcuuuuucuccagacugaacuggcucacacauagcaaguuuaaauauccugcccugaaugucaccaugcccaacaacgaggaguucgacaaacuuuacauuuggggagugcaccauccuggcacggauaaugaccagaucuuucuguaugcgcaggccucugggcggauuacaguuuccaccaagcgcagccaacagacagugaucccgaacauuggauccagaccccggguccgcaauaucccuucuagaaucagcauuuacuggaccaucgugaagcccggcgauauucuccugaucaacuccaccgggaaucugauugcuccucggggauacuucaucauccgcagcggcaaaucuuccauuaugagaagcgacgcccccaucggcaaguguaacucugaaugcauuacaccgaaugggagcaucccuaacgacaagcccuuucagaaugugaaccggauuacguauggagcuuguccucgcuacgucaaacagaauacccucaagcuggccacaggcaugagaaacguucccgagaaacaaacccgggggaucuucggagcgaucgccggcuuuauugaaaaugggugggagggaaugguggauggcugguauggcuuccgccaccagaacuccgaggggaucggacaggcugccgaccuuaagucuacacaagcugccauugaucagaucaauggcaaacugaacagacucauugggaagaccaacgaaaaauuccaccagaucgagaaggaauuuagcgagguggaaggacggauucaggaccuggagaaguacgucgaggauacgaaaaucgaccuuugguccuauaaugccgaacugcucguggcucuggagaaccaacauacaaucgaucugaccgacagcgaaaugaauaaacucuucgagaagaccaagaaacagcugagagaaaacgcggaggauaugggcaaugggugcuuuaagauuuaccacaagugugacaacgccugcaucggcucuauucgcaauggaacauaugaucaugacguuuaccgggacgaggcucuuaacaauagauuccagaucaaaggcguggaacugaaguccggguacaaagauuggauucucuggaucagcuuugccaucucuugcuuccugcuuugugucgcccugcucggauuuauuaugugggcuugccagaagggcaacauccgcuguaauauuugcaucuga

SEQ ID NO: 184752 - RNA, 1701 nt, Artificial Sequence
  derived and/or modified sequence opt5 from hemagglutinin__InfluenzaA__ABS71677
augaagaccaucauugcccugagcuacauccucugccugguguucgcucagaaacuucccggcauugacaacuccacagccacgcugugucucgggcaccaugcggucccuaauggaaccaucguuaagacaauuaccgaugaccaaaucgaggugacaaacgcuaccgaacuggugcaaaauucuagcacaggcgggaucugcgauuccccgcaccagauucuugacggagagaacuguacccugaucgaugcccuccugggcgacccccagugcgauggguuucagaauaaaaagugggaccuguucgucgaaagaucuaaagccuauagcaacuguuacccuuaugaugugcccgacuacgcuucccuccggucucugguugccagcuccggaacgcuugaguuuaauaacgaaucuuucaauuggaccggcgugacacagaacggcaccucuuccgcuugcaagcgcgggagcaauaacagcuuuuucuccagacugaauuggcucacacauagcaaguuuaaauauccugcccugaacgucaccaugcccaauaacgaggaguucgauaaacuuuacauuuggggagugcaccauccuggcacggacaacgaucagaucuuucuguaugcgcaggccucugggcggauuacaguuuccaccaagcgcagccaacagacagugaucccgaauauuggauccagaccccggguccgcaacaucccuucuagaaucagcauuuacuggaccaucgugaagcccggcgacauucuccugaucaauuccaccgggaaccugauugcuccucggggauacuucaaaauccgcagcggcaagucuuccaucaugagaagcgacgcccccauugauaaguguaauucugaaugcaucacaccgaacggcagcauuccuaaugacaaacccuuucagaacgugaaucggaucacguauggggcuuguccucgcuacgucaagcagaacacccucaaacuggccacaggaaugagaaauguucccgagaagcaaacccggggcauuuucggggcgaucgccggauuuaucgaaaacggcugggaggggaugguggauggaugguauggcuuccgccaccaaaauuccgagggcauugggcaggcugccgaccuuaaaucuacacaggcugccaucgaucagauuaacggaaagcugaauagacucaucggcaaaaccaacgaaaaguuccaccagauugagaaggaauuuagcgagguggaagggcggauccaggaccuggagaaauacgucgaggauacgaagauugaccuuugguccuauaacgccgaacugcucguggcucuggagaaucaacauacaaucgaucugaccgacagcgaaaugaacaaacucuucgagaagaccaaaaagcagcugagagaaaaugcggaggauaugggaaacggcugcuuuaagaucuaccacaaaugugacaaugccugcauugggucuauccgcaacggcacauaugaccaugauguuuaccgggacgaggcucuuaauaacagauuccagauuaagggaguggaacugaaauccggcuacaaggauuggauccucuggauuagcuuugccaucucuugcuuccugcuuugugucgcccugcucggguuuaucaugugggcuugccagaaaggaaauauucgcuguaacaucugcauuuga

SEQ ID NO: 184753 - RNA, 1701 nt, Artificial Sequence
  derived and/or modified sequence opt5 from hemagglutinin__InfluenzaA__ABS71679
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauuggaccggcgugacacagaacggcaccuccagcgcuugcaagcgcgggucuaauaacuccuuuuucagcagacugaauuggcucacacauucuaaguuuaaauauccugcccugaacgucaccaugcccaauaacgaggaguucgacaaacuuuacauuuggggagugcaccauccuggcacggauaacgaccagaucuuucuguaugcgcaggccuccgggcggauuacaguuagcaccaagcgcucccaacagacagugaucccgaauauuggaucuagaccccggguccgcaacaucccuagcagaaucuccauuuacuggaccaucgugaagcccggcgauauucuccugaucaauagcaccgggaaccugauugcuccucggggauacuucaaaauccgcucuggcaaguccagcaucaugagaucugacgcccccauuggcaaguguaauagcgaaugcaucacaccgaacggguccauuccuaaugacaaacccuuucagaacgugaaucggaucacguauggagcuuguccucgcuacgucaagcagaacacccucaaacuggccacaggcaugagaaauguucccgagaagcaaacccgggggauuuucggagcgaucgccggcuuuaucgaaaacgggugggagggaaugguggauggcugguauggcuuccgccaccaaaauucugaggggauuggacaggcugccgaccuuaaaagcacacaggcugccaucgaucagauuaacggcaagcugaauagacucaucgggaaaaccaacgaaaaguuccaccagauugagaaggaauuuuccgagguggaaggacggauccaggaccuggagaaauacgucgaggauacgaagauugaccuuuggagcuauaacgccgaacugcucguggcucuggagaaucaacauacaaucgaucugaccgacucugaaaugaacaaacucuucgagaagaccaaaaagcagcugagagaaaaugcggaggauaugggcaacgggugcuuuaagaucuaccacaaaugugacaaugccugcauuggcuccauccgcaacggaacauaugaucaugacguuuaccgggacgaggcucuuaauaacagauuccagauuaagggcguggaacugaaaagcggguacaaggauuggauccucuggauuucuuuugccaucuccugcuuccugcuuugugucgcccugcucggauuuaucaugugggcuugccagaaaggcaauauucgcuguaacaucugcauuuga

SEQ ID NO: 184754 - RNA, 1701 nt, Artificial Sequence; identical to SEQ ID NO: 184753
  derived and/or modified sequence opt5 from hemagglutinin__InfluenzaA__ABS71680

SEQ ID NO: 184755 - RNA, 1701 nt, Artificial Sequence
  derived and/or modified sequence opt5 from hemagglutinin__InfluenzaA__ABS71682
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucuuucucuaugcgcaggccucuggccgcauuacaguguccaccaagagaagccaacagacaguuaucccgaacauugggucccggccccgcgugagaaauaucccuucucggaucagcauuuacuggaccaucgucaaacccggagauauucugcugaucaacuccaccggcaaucucauugcuccucgcggguacuucaagaucagaagcggaaagucuuccaucaugcggagcgacgcccccauuggcaaauguaacucugagugcaucacaccgaauggcagcauuccuaacgacaagcccuuucagaaugugaaccgcaucacguauggggcuuguccuagauacgugaaacagaauacccugaaacuugccacaggaaugcggaacguccccgaaaaacaaacccgcggcauuuucggggcgaucgccggauuuaucgagaauggcugggaagggaugguugauggaugguauggcuucagacaccagaacuccgagggcauugggcaggcugccgaccugaagucuacacaagcugccaucgaucagauuaauggaaaacucaaccggcugaucggcaagaccaacgagaaguuccaccagauugaaaaagaguuuagcgaaguggaggggagaauccaggaccuugaaaaguacguggaggauacgaaaauugaccugugguccuauaaugccgagcuccuggucgcucuggaaaaccaacauacaaucgaucucaccgacagcgagaugaauaagcuguucgaaaagaccaagaagcagcuucgcgagaacgcggaagauaugggaaauggcugcuuuaaaaucuaccacaagugugacaacgccugcauugggucuauccggaauggcacauaugaucaugacguguacagagacgaggcucugaacaaucgcuuccagauuaaaggaguugagcucaaguccggcuacaaagauuggauccuguggauuagcuuugccaucucuugcuuccuucugugugugguccuccugggguuuaucaugugggccugccagaagggaaacauucgguguaauaucugcauuuga

SEQ ID NO: 184756 - RNA, 1701 nt, Artificial Sequence
  derived and/or modified sequence opt5 from hemagglutinin__InfluenzaA__ABU80177
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcucuugcaagagacgguccauuaagagcuuuuucucucgccucaacuggcugcaucaacuuaaauauaaguacccugcccugaaugugacaaugcccaacaaugagaaauuugacaagcucuauaucuggggcguucaccacccuuccaccgauagcgaccagauuucccuguacgcgcaggccucuggcagagugacggucagcacaaaacggucccagcaaaccgugaucccgaacauugggagccgccccugggugagaggagucucuucccggaucagcauuuacuggacaaucguuaagccuggcgauauccugcucauuaacucuaccgggaaucugaucgcuccccgcggauauuucaaaauuagaagcggcaaguccucuaucaugcggagcaacgccccuauugggaaguguaauuccgaaugcaucacccccaacggaagcaucccgaaugacaaaccuuuucagaacgugaaucgcauuacauacggcgcuugucccagauaugugaagcagaacacgcuuaaacuggccaccggcaugcggaaugucccugagaagcagacacgcgggaucuucggagcgauugccggcuuuaucgaaaacgggugggagggaaugguggacggcugguacggguucagacaucaaaauucugagggaaccggccaggcugccgaucucaaauccacacaggcugccauuaaccaaaucaauggcaagcugaaccggcuuaucgagaaaaccaaugaaaaguuucaccagauugaaaaggaguucagcgaaguugaggggagaauccaggaccuggagaaauauguggaagauacgaagauugaccucuggucuuacaacgccgagcugcuggucgcucucgaaaaccagcauacaaucgaucugaccgacuccgagaugaauaaacuuuucgaacgcacccggaagcaacugagagagaacgcggaggauaugggaaauggcugcuuuaaaauuuaucacaagugugacaacgccugcaucgggagcauucgcaauggaacauacgaucacgacguguaccgggaugaagcucucaacaauagauuccagaucaagggcguugagcugaaauccggguauaaggacuggauccuuuggauuucuuuugccaucagcugcuuccugcucugugugguccugcugggcuuuauuaugugggccugccagaaaggaaacauccgcuguaauauuugcaucuga

SEQ ID NO: 184757 - RNA, 1698 nt, Artificial Sequence
  derived and/or modified sequence opt5 from hemagglutinin__InfluenzaA__ABU80298
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauaugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaauggcuaccggacuccggaauauucccagcauccagucccgcggccuguuuggggccauugcuggauucaucgaaggcggguggacaggaaugguugacggcugguauggcuaccaucaccagaacgagcaagggucuggauacgccgccgaucagaaaagcacgcagaaugcuauuaacggcaucaccaauaaggugaacuccgucaucgaaaagaugaauacacaguuuaccgcgguggggaaagaguucaacaaacuggagagacggauggaaaaucucaacaagaagguugacgauggauuccuggacauuuggacauauaacgccgagcuucuggugcuccuggaaaaugagcgcacccuugacuuucacgauagcaacgucaaaaaucuguacaagaaagugaagucucaacucaaaaacaaugcuaaggaaaucggcaacgggugcuucgaguuuuaucauaaguguaauaacgagugcauggaauccgucaaaaauggcacguacgacuaucccaaguacagcgaggaaucuaaacugaacagagagaagauugauggagugaaacuggaguccaugggcguuuaucagauccucgccauuuacagcacaguggccuccucucugguccuucuggugagccucggggcuaucuccuucuggaugugcucuaauggaagccugcagugucggaucugcauuuga

SEQ ID NO: 184758 - RNA, 1701 nt, Artificial Sequence
  derived and/or modified sequence opt5 from hemagglutinin__InfluenzaA__ABU80320
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcgggauuugcgacucuccgcaccagauccuggauggagagaauuguacccucaucgacgcccugcugggcgauccccauugcgacagcuuucagaacaaagaaugggaucucuucgucgagagauccaaggccuauucuaauuguuacccuuaugacgugcccgauuacgcuagccugcggucccuuguugccagcucugggacgcuggaauuuaacaaugaguccuucaacuggaccggaguggcucaaaauggcacaagcucugccugcaaacgcagauccaacaagagcuuuuucucucggcucaauuggcugcaccagcuuaaguauaaauacccugcgcugaacgucaccaugcccaauaacgagaaguuugacaaacucuauauuuggggcgugcaucacccuuccacagauagcgaccagaucucccuguacgcccaggcuccggggcgcguuaccgugucuacgaagagaagccaacagacagucauucccaacaucggaucccggccuugggugcgcggcgugagcucuauuaucuccauuuacuggaccaucgucaaacccggggauauccugcucauuaauuguacaggaaaccugaucgccccuagaggcuauuucaagauucggagcgggaagucuagcaucaugcgcuccgacgcuucuauuggaaaaugcaauagcgaauguaucacccccaacggcuccaucccgaaugacaagccuuuucagaacguuaauagaauuaccuacggcgccugcccccgguaugugaaacagaacacacuuaagcuggcgacggggaugcgcaaugugccugagaaacaaaccagaggaaucuucggcgccauugcuggguuuaucgaaaacggaugggagggcauggucgaugggugguacggauuccggcaccagaauagcgagggcacaggccaggccgcugaccucaagucuacccaagccgccauuaaccagaucaaugggaaacugaaccgccuuaucgaaaagacaaaugagaaguuucaucagauugaaaaagaguucuccgaaguggagggaagaauccaggaucuggagaaguauguugaagacaccaaaauugaucucuggagcuacaacgcugagcugcugguggcgcucgaaaaccaacacacgaucgaccugacagauucugagaugaauaaacuuuucgaacggaccaagaagcagcugagagagaacgccgaggacaugggcaauggguguuuuaagauuuaucauaaaugcgauaacgcuugcaucggauccauucgcaauggcaccuacgaccacgaugucuaccgggacgaagcccucaacaauagauuccagaucaaggggguggagcugaaaagcggcuauaaggacuggauccuuuggauuuccuuugccaucucuuguuuccugcucugcguugugcugcugggauuuauuaugugggcuugucagaaaggcaacauccgcugcaauauuuguaucuga

SEQ ID NO: 184759 - RNA, 1701 nt, Artificial Sequence; identical to SEQ ID NO: 184063
  derived and/or modified sequence opt5 from hemagglutinin__InfluenzaA__ABU80331

SEQ ID NO: 184760 - RNA, 1701 nt, Artificial Sequence
  derived and/or modified sequence opt5 from hemagglutinin__InfluenzaA__ABU80400
augaaggccauccugcucgugcugcuuuacaccuucacagcugccaacgcggacacgcugugcauuggcuaucacgcuaauaacagcaccgauacagucgacaccguucucgagaaaaaugugacagugacccauuccgucaaccugcuugaagauagacacaaugggaagcuguguaaacuccggggaguggcuccccugcaucugggcaagugcaacaucgccggguggcuccugggaaauccugagugugaacuucuguuuacagccucuagcugguccuacauuguugagaccucuaacagcgacaauggcacgugcuauccgggggauuucaucaacuacgaagaacuccgcgagcagcuguccucugugagcuccuuugaaagauucgagauuuuucccaaagccagcucuuggccuaaucacgaaaccaaccggggagucacagcugccugucccuaugcgggcgccaauuccuucuaccgcaaccuuaucuggcuggugaagaagggcaauagcuauccuaaacucucuaaguccuacguuaacaacaaagagaaggaggugcugguccugugggggauccaucaucccccuaccagcacagaccaacagucucucuaccagaaugcugaugccuauguguuugugggauccagcaaauacaacaagaaguucaaaccggaaauugcuaccagacccaagguccggggccaggccgggcgcaugaauuauuacuggacgcugguugagccuggagacacaaucaccuuugaagcgacaggcaaccuuguggugcccagauaugccuucgcuaugaaacggggguccggaucuggcauuaucauuagcgauaccccuguccacgacugcaauaccacaugucaaacgcccaagggcgccaucaacaccucccugccguuucagaauauucacccugugacaaucggggagugccccaaauacguuaagagcaccaaacuccgcauggcuacaggacugagaaacaucccuucuauucagucccggggccuuuucggggccaucgccggauuuauugaaggcggguggaccggaaugaucgauggcugguauggcuaccaccaucagaaugagcaagggagcggauacgcugcggaccgcaagucuacgcagaacgccauugauggcaucacaaauaaggugaacagcgucaucgagaaaaugaauacccaguucaccgcuguggggaaggaguucaaccaccuggagaaaagaauugaaaaucucaaccggaagguugacgacggauuucuggauaucuggacauauaacgccgagcugcucgugcugcuugaaaaugagcgcacccuggacuaccacgauuccaacgucaaaaaucucuaugagaaggugagaucucagcugaagaacaaugccaaagaaauuggcaacggguguuucgaguuuuaccauaagugcgacgauacauguauggaaagcgucaaaaauggcacguaugacuaccccaaguauuccgaggaaagcaaacuuaaccgggaggagaucgauggagugaagcuggaaucuaccagaauuuaccaaauccucgcuaucuacuccacaguugccagcucucuggugcugcucgucucccugggcgcgauuagcuucuggaugugcuccaaugggucucuucagugccgcaucuguauuuga

SEQ ID NO: 184761 - RNA, 1701 nt, Artificial Sequence
  derived and/or modified sequence opt5 from hemagglutinin__InfluenzaA__ABU92572
augaagaccaucauugcccugagcuacauccucugccugguguucacacagaaacuucccggcaacgacaauuccacggcuacccugugucucgggcaccaugccgucccuaacggaacacugguuaagaccauuacaaaugaucaaaucgaggugaccaacgcgacagaacuugugcagucuagcuccaccggcagaauuugcgacucuccgcaccagauccuggauggggagaauuguacgcucaucgacgcucugcugggagauccccauugcgacggcuuucagaacaaagaaugggaucucuucgucgagcggagcaaggccuauuccaauuguuacccuuaugacgugcccgauuacguuucucugcgcagccuuguggccuccagcgggacccuggaauuuaacaaugagucuuucaacuggacaggagucgcucaaaauggcaccuccagcgccugcaaaagacggucugacaaguccuuuuucagccgccucaacuggcugcaccagcuuaaguauaaauacccugcucugaaugugacaaugcccaacaaugagaaguuugauaaacucuauauuuggggcguucaucacccugggaccgacucugaucagaucucccuguacgcccaggcgagcggaagagugacggucuccacaaagcggucucaacagaccgugauuccgaacaucggcagccgccccugggugagaggggucuccagccggauuucuaucuacuggacaauuguuaaaccuggagacauccugcucaucaacuccaccggcaaucugauugcccccagaggguauuucaagaucagaagcggaaagucuagcauuaugcgguccgacgcuccuaucggcaaauguaacucugaaugcauuacccccaauggcagcaucccgaacgauaagccuuuucagaaugugaaccgcaucacauacgggcccuguccuagauaugugaaacagaauacgcuuaagcuggccaccggaaugcggaacguccccgagaaacaaacacgcggcauuuucggggcuaucgccggauuuauugaaaauggcugggaggggaugauggacggaugguacggcuucagacaccagaacuccgagggcaccgggcaggcggccgaucucaagagcacacaagcugccaucaaucagauuaacggaaaacugaaucggcuuaucgaaaagaccaacgagaaguuucaucagaucgaaaaagaguucucugaaguggagggccgcauucaggaccuggagaaguauguugaagauacgaaaaucgaccucugguccuacaaugcugagcugcugguggcccucgaaaaccaacacacaauugaucugaccgacagcgagaugaacaaacuuuucgaacgcaccaagaagcagcugcgggagaaugccgaggauauggggaacggaugcuuuaagaucuaucauaaaugugacaaugcuugcauuggcucuaucagaaacgggacauacgaucacgacgucuaccgcgacgaagcgcucaauaaccgguuccagauuaagggcguggagcugaaauccggauauaaggauuggauccuuuggaucagcuuugccauuuccugcuuccugcucuguaucguucugcugggcuuuauuaugugggcuugccagaaagggaauaucagauguaacauuugcaucuga

SEQ ID NO: 184762 - RNA, 1701 nt, Artificial Sequence
  derived and/or modified sequence opt5 from hemagglutinin__InfluenzaA__ABU92573
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagccgccccugggugagaggggucuccagccggauuucuaucuacuggaccauuguuaaaccuggagacauccugcucaucaacuccacaggcaaucugauugcuccccgcggguauuucaagaucagaagcggaaagucuagcauuaugcgguccgacgccccuaucggcaaauguaacucugaaugcauuacccccaauggcagcaucccgaacgggaagccuuuucagaaugugaaccgcaucaccuacggagcuugucccagauaugugaaacagaauacacuuaagcuggccacgggcaugcggaacgucccugagaaacaaacccgcgggauuuucggagcgaucgccggcuuuauugaaaaugggugggagggaaugauggauggcugguacggcuucagacaccagaacuccgaggggacaggacaggcugccgaccucaagagcacccaagcugccaucaaucagauuaacggcaaacugaaucggcuuaucaagaagacaaacgaaaaauuucaucagaucgagaaggaguucucugaaguggaagggcgcauucaggaucuggagaaauauguugaggacaccaagaucgaucucugguccuacaaugccgaacugcugguggcucucgagaaccaacacacgauugaccugacagauagcgaaaugaacaaacuuuucgagagaaccaagaagcagcugcgggaaaaugcggaggacaugggaaacggcugcuuuaaaaucuaucauaagugugauaaugccugcauugggucuaucagaaacggcaccuacgaccacgaugucuaccgcgacgaggcucucaauaaccgguuccagauuaaaggaguggaacugaaguccggcuauaaagacuggauccuuuggaucagcuuugccauuuccugcuuccugcucuguaucguucugcugggguuuauuaugugggccugccagaagggaaauaucagauguaacauuugcaucuga

SEQ ID NO: 184763 - RNA, 1701 nt, Artificial Sequence
  derived and/or modified sequence opt5 from hemagglutinin__InfluenzaA__ABU92575
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcaaacccugggugcgcggggucuccagcagaauuucuaucuacuggaccauuguuaagccuggagacauccugcucaucaacuccacaggcaaucugauugcuccccggggguauuucaagauccgcagcggaaaaucuagcauuaugagauccgacgccccuaucggcaaguguaacucugaaugcauuacccccaauggcagcaucccgaacgauaaaccuuuucagaaugugaaccggaucaccuacgggcccuguccucgcuaugugaagcagaauacacuuaaacuggcuacgggaaugagaaacguccccgagaagcaaacccggggcauuuucggggccaucgcgggauuuauugaaaauggcugggaggggaugauggacggaugguacggcuuccgccaccagaacuccgagggcacagggcaggccgcugaucucaaaagcacccaagccgcuaucaaucagauuaacggaaagcugaauagacuuaucgaaaagacaaacgagaaauuucaucagaucgaaaaggaguucucugaaguggagggccggauucaggaccuggagaaauauguugaagauaccaagaucgaccucugguccuacaaugccgagcugcugguggcccucgaaaaccaacacacgauugaucugacagacagcgagaugaacaaacuuuucgaaagaaccaagaagcagcugcgcgagaaugcugaggauauggggaacggaugcuuuaaaaucuaucauaagugugacaaugcgugcauuggcucuauccggaacgggaccuacgaucacgacgucuacagagacgaagcccucaauaaccgcuuccagauuaaaggcguggagcugaaguccggauauaaagauuggauccuuuggaucagcuuugcuauuuccugcuuccugcucuguaucguucugcugggcuuuauuaugugggccugccagaaggggaauauccgguguaacauuugcaucuga

SEQ ID NO: 184764 - RNA, 1701 nt, Artificial Sequence; identical to SEQ ID NO: 183075
  derived and/or modified sequence opt5 from hemagglutinin__InfluenzaA__ABU92576

SEQ ID NO: 184765 - RNA, 1701 nt, Artificial Sequence; identical to SEQ ID NO: 183075
  derived and/or modified sequence opt5 from hemagglutinin__InfluenzaA__ABU92577

SEQ ID NO: 184766 - RNA, 1701 nt, Artificial Sequence; identical to SEQ ID NO: 183096
  derived and/or modified sequence opt5 from hemagglutinin__InfluenzaA__ABU92578

SEQ ID NO: 184767 - RNA, 1701 nt, Artificial Sequence; identical to SEQ ID NO: 183096
  derived and/or modified sequence opt5 from hemagglutinin__InfluenzaA__ABU92579

SEQ ID NO: 184768 - RNA, 1701 nt, Artificial Sequence; identical to SEQ ID NO: 183096
  derived and/or modified sequence opt5 from hemagglutinin__InfluenzaA__ABU92580

SEQ ID NO: 184769 - RNA, 1701 nt, Artificial Sequence; identical to SEQ ID NO: 184761
  derived and/or modified sequence opt5 from hemagglutinin__InfluenzaA__ABU92581

SEQ ID NO: 184770 - RNA, 1701 nt, Artificial Sequence
  derived and/or modified sequence opt5 from hemagglutinin__InfluenzaA__ABU92582
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccagaaugugaccaugcccaacaaugagaaguuugauaaacuguauauuuggggcguucaucacccugggacagacucugaucagaucucccucuacgcgcaagccagcggaagagugaccgucuccacgaagcggucucagcagacagugauuccgaacaucggcagccgccccugggugagaggggucuccagccggauuucuaucuacuggaccauuguuaaaccuggagacauccugcugaucaacuccacaggcaaucucauugcuccccgcggguauuucaagaucagaagcggaaagucuagcauuaugcgguccgacgccccuaucggcaaauguaacucugaaugcauuacccccaauggcagcaucccgaacgauaagccuuuucagaaugugaaccgcaucaccuacggggcuugucccagauaugugaaacaaaauacacugaagcuggccacgggaaugcggaacgucccugagaaacagacccgcggcauuuucggggcgaucgccggauuuauugaaaauggcugggaggggaugauggacggaugguacggcuucagacaccagaacuccgagggcacagggcaagcugccgaucuuaagagcacccaggcugccaucaaucagauuaacggaaaacucaaucggcugaucgaaaagacaaacgagaaguuucaucagaucgaaaaagaguucucugaaguggagggccgcauucaagaccuugagaaguauguugaagauaccaaaaucgaccugugguccuacaaugccgagcuccugguggcucuggaaaaccagcacacgauugaucucacagacagcgagaugaacaagcuguucgaaagaaccaaaaagcagcuucgggagaaugcggaggauauggggaacggaugcuuuaagaucuaucauaaaugugacaaugccugcauuggcucuaucagaaacgggaccuacgaucacgacgucuaccgcgacgaagcucugaauaaccgguuccagauuaagggcguggagcucaaauccggauauaaggauuggauccuguggaucagcuuugccauuuccugcuuccuucuguguaucguucuccugggcuuuauuaugugggccugccaaaaagggaauaucagauguaacauuugcaucuga

SEQ ID NO: 184771 - RNA, 1701 nt, Artificial Sequence; identical to SEQ ID NO: 184770
  derived and/or modified sequence opt5 from hemagglutinin__InfluenzaA__ABU92583

SEQ ID NO: 184772 - RNA, 1701 nt, Artificial Sequence
  derived and/or modified sequence opt5 from hemagglutinin__InfluenzaA__ABU92584
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuagauauaaguacccugcccugaaugugaccaugcccaacaaugagaaauuugauaagcucuauauuuggggcguucaucacccugggacagacucugaucagaucucccuguacgcgcaggccagcggacgggugaccgucuccacgaaacgcucucaacagacagugauuccgaacaucggcagcagacccugggugcgcggggucuccagccggauuucuaucuacuggaccauuguuaagccuggagacauccugcucaucaacuccacaggcaaucugauugcucccagaggguauuucaaaauccggagcggaaagucuagcauuaugcgcuccgacgccccuaucggcaaguguaacucugaaugcauuacccccaauggcagcaucccgaacgauaaaccuuuucagaaugugaacagaaucaccuacggggcuuguccccgguaugugaagcagaaaacacuuaagcuggccacgggaaugcgcaaugucccugagaaacaaaccagaggcauuuucggggcgaucgccggauuuauugaaaacggcugggaggggaugauggacggaugguacggcuuccggcaccaaaauuccgagggcacagggcaggcugccgaucucaagagcacccaggcugccaucaaccagauuaauggaaaacugaacagacuuaucgaaaagacaaaugagaaguuucaucagaucgaaaaagaguucucugaaguggagggccgcauucaggaccuggagaaguauguugaagauaccaaaaucgaccucugguccuacaacgccgagcugcugguggcucucgaaaaucaacacacgauugaucugacagacagcgagaugaacaaacuuuucgaacggaccaagaagcagcugagagagaacgcggaggauauggggaauggaugcuuuaagaucuaucauaaaugugacaacgccugcauuggcucuauccgcaaugggaccuacgaucacgacgucuaccgggacgaagcucucaacaauagauuccagauuaagggcguggagcugaaauccggauauaaggauuggauccuuuggaucagcuuugccauuuccugcuuccugcucuguaucguucugcugggcuuuauuaugugggccugccagaaagggaacauccgcuguaauauuugcaucuga

SEQ ID NO: 184773 - RNA, 1701 nt, Artificial Sequence
  derived and/or modified sequence opt5 from hemagglutinin__InfluenzaA__ABU92586
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacggauaacgaccagaucucccucuaugcgcaggccagcggccgcauuacaguguccaccaaaagaucucaacagacaguuaucccgaauauugggagccggccccgcgugagagauaucccuucccggaucagcauuuacuggaccaucgucaagcccggagacauucugcugaucaacucuaccggcaaucucauugcuccucgcggguacuuuaaaaucagauccggaaagagcucuaucaugcggagcgacgcccccauuggcaaguguaacuccgaaugcaucacaccgaauggcucuauuccuaacgauaaacccuuccagaaugugaaccgcaucacguauggggcuuguccuagauacgugaagcagaauacccugaaacuugccacaggaaugcggaacguccccgagaagcaaacccgcggcauuuuuggggcgaucgccggauucaucgaaaauggcugggaggggaugguugacggaugguauggcuuuagacaccagaacagcgagggcauugggcaggcugccgaucugaaauccacacaagcugccaucgaccagauuaauggaaagcucaaccggcugaucggcaaaaccaaugaaaaguuccaccagauugagaaggaguucagcgaaguggaagggagaauccaggaucuugagaaauacguggaggacacgaagauugaucuguggucuuauaacgccgaacuccuggucgcucuggagaaccaacauacaaucgaccucaccgauuccgaaaugaauaaacuguuugagcgcaccaagaaacagcuucgggaaaacgcggaggacaugggaaauggcugcuucaagaucuaccacaagugugauaacgccugcauugggagcaucagaaauggcacauaugaccaugacguguaccgcgaugaggcucugaacaaucgguuucagauuaaaggaguugaacucaagucuggcuacaaaaacuggauccuguggauuuccuucgccaucagcugcuuucuucuguguguggcccuccugggguucaucaugugggcuugccagaagggaaauauuagauguaacaucugcauuuga

SEQ ID NO: 184774 - RNA, 1701 nt, Artificial Sequence
  derived and/or modified sequence opt5 from hemagglutinin__InfluenzaA__ABU92587
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacagcuaucccgaauauugggagccggccccgcguuagagacaucccuucccggaucagcauuuacuggaccaucgugaagcccggagauauucugcugaucaacucuaccggcaaucucauugccccucgcggguauuuuaaaaucagauccggaaagagcucuaucaugcggagcgacgcucccauuggcaaguguaacuccgaaugcaucacaccgaauggcucuauuccuaacgacaaacccuuccagaaugucaaccgcaucacguacggggccuguccuagauaugugaagcagaauacccugaaacuugcgacaggaaugcggaacgugcccgagaagcaaacccgcggcauuuuuggggccaucgcuggauucaucgaaaauggcugggaggggauggucgauggaugguacggcuuuagacaccagaacagcgagggcauugggcaggccgcugaccugaaauccacacaagccgccaucgaucagauuaauggaaagcucaaccggcugaucggcaaaaccaaugaaaaguuccaccagauugagaaggaguucagcgaaguugaagggagaauccaggaccuugagaaauauguggaggauacgaagauugaccuguggucuuacaacgcugaacuccugguggcgcuggagaaccaacauacaaucgaucucaccgacuccgaaaugaauaaacuguuugagcgcaccaagaaacagcuucgggaaaacgccgaggauaugggaaauggcugcuucaagaucuaucacaagugugacaacgcuugcauugggagcaucagaaauggcacauacgaucaugacgucuaccgcgacgaggcccugaacaaucgguuucagauuaaaggaguggaacucaagucuggcuauaaagauuggauccuguggauuuccuucgccaucagcugcuuucuucuguguguugcucuccugggguucaucaugugggccugccagaagggaaacauuagauguaauaucugcauuuga

SEQ ID NO: 184775 - RNA, 1701 nt, Artificial Sequence
  derived and/or modified sequence opt5 from hemagglutinin__InfluenzaA__ABU92588
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaauuccuuuuucagcagacugaacuggcucacacaucugaaauuuaaguauccugcccuuaaugucaccaugcccaacaacgagaaauucgacaagcuguacaucuggggagugcaccauccugggacggauaaugaccagauuucucucuaugcgcaggccuccggccggaucacaguuagcaccaaacgcucccaacagacagugauuccgaacaucgggucuagaccccggguccgcgauauuccuagcagaaucuccaucuacuggaccauugugaagcccggagacauccugcugauuaauagcaccggcaaccucaucgcuccucggggguacuuuaagauucgcucuggaaaauccagcaucaugagaucugacgcccccaucggcaaguguaauagcgagugcauuacaccgaacggcuccaucccuaaugauaaacccuuccagaacgugaaucggauuacguauggggcuuguccucgcuacgucaagcagaacacccugaaacuugccacaggaaugagaaauguucccgaaaagcaaacccggggcaucuuuggggcgauugccggauucaucgagaacggcugggaagggaugguggacggaugguauggcuuucgccaccagaauagcgagggcaucgggcaggcugccgaucugaaaagcacacaagcugccauuaaccagaucaauggaaagcucaacagacugauuggcaagaccaacgagaaauuccaccagaucgaaaaggaguucuccgaaguggaggggcggauucaggaccuugaaaaauacgucgaggauacgaagaucgaccuguggagcuauaaugccgaguuucucguggcucuggaaaaccaacauacaauugaucugaccgacucugagaugaauaaacucuucgaaagaaccaagaagcagcugcgcgagaacgcggaagauaugggaaauggcugcuuuaaaaucuaccacaagugugacaacgccugcaucggguccauucggaauggcacauaugaucaugacguuuacagagacgaggcucuuaacaaucgcuuccagaucaaaggaguggagcugaagucuggcuacaaagauuggauucucuggaucucuuuugccauuuccugcuuccugcuuugugucgcccugcucggguuuaucaugugggcuugccagaagggaaacauccgguguaauauuugcaucuga

SEQ ID NO: 184776 - RNA, 1701 nt, Artificial Sequence; identical to SEQ ID NO: 183657
  derived and/or modified sequence opt5 from hemagglutinin__InfluenzaA__ABU92590

SEQ ID NO: 184777 - RNA, 1701 nt, Artificial Sequence
  derived and/or modified sequence opt5 from hemagglutinin__InfluenzaA__ABU92591
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacggauaacgaccagaucucccucuaugcgcaggccagcggccgcauuacaguguccaccaaaagaucucaacagacaguuaucccgaauauugggagccggccccgcgugagagauaucccuucccggaucagcauuuacuggaccaucgucaagcccggagacauucugcugaucaacucuaccggcaaucucauugcuccucgcggguacuuuaaaaucagauccggaaagagcucuaucaugcggagcgacgcccccauuggcaaguguaacuccgaaugcaucacaccgaauggcucuauuccuaacgauaaacccuuccagaaugugaaccgcaucacguauggggcuuguccuagauacgugaagcagaauacccugaaacuugccacaggaaugcggaacguccccgagaagcaaacccgcggcauuuuuggggcgaucgccggauucaucgaaaauggcugggaggggaugguugacggaugguauggcuuuagacaccagaacagcgagggcauugggcaggcugccgaucugaaauccacacaagcugccaucgaccagauuaauggaaagcucaaccggcugaucggcaaaaccaaugaaaaguuccaccagauugagaaggaguucagcgaaguggaagggagaauccaggaucuugagaaauacguggaggacacgaagauugaucuguggucuuauaacgccgaacuccuggucgcucuggagaaccaacauacaaucgaccucaccgauuccgaaaugaauaaacuguuugagcgcaccaagaaacagcuucgggaaaacgcggaggacaugggaaauggcugcuucaagaucuaccacaagugugauaacgccugcauugggagcaucagaaauggcacauaugaccaugacguguaccgcgaugaggcucugaacaaucgguuucagauuaaaggaguugaacucaagucuggcuacaaagacuggauccuguggauuuccuucgccaucagcugcuuucuucuguguguggcccuccugggguucaucaugugggcuugccagaagggaaacauuagauguaauaucugcauuuga

SEQ ID NO: 184778 - RNA, 1701 nt, Artificial Sequence; identical to SEQ ID NO: 184777
  derived and/or modified sequence opt5 from hemagglutinin__InfluenzaA__ABU92592

SEQ ID NO: 184779 - RNA, 1701 nt, Artificial Sequence
  derived and/or modified sequence opt5 from hemagglutinin__InfluenzaA__ABU92593
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaaacaaacccgcggcaucuucggggcgauugccggauuuaucgagaauggcugggaagggaugguggauggaugguauggcuucagacaccagaacuccgagggcaucgggcaggcugccgaccugaagucuacacaagcugccauugaucagaucaauggaaaacucaaccggcugauuggcaagaccaacgagaaguuccaccagaucgaaaaagaguuuagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguucgaaaagaccaagaagcagcuuagagagaacgcggaagauaugggaaauggcugcuuuaaaaucuaccacaagugugacaacgccugcaucgggucuauucggaauggcacauaugaucaugacguuuacagagacgaggcucugaacaaucgcuuccagaucaaaggaguggagcucaaguccggcuacaaagauuggauucuguggaucagcuuugccauuucuugcuuccuucugugugucgcccuccugggguuuaucaugugggcuggacagaagggcaacaagcggugcaauaucuguauuuga

SEQ ID NO: 184780 - RNA, 1701 nt, Artificial Sequence
  derived and/or modified sequence opt5 from hemagglutinin__InfluenzaA__ABU92594
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaagcuguacccugauugaugcccuccugggagacccccagugcgauggcuuucaaaacaaaaagugggaccuguucgucgagagauccaaagccuauucuaauuguuacccuuaugaugugcccgacuacgcuagccuccggucccugguugccagcucugggacgcuugaauuuaacaaugaguccuucaacuggaccggagugacacagaauggcaccagcucugcuugcaagcgcagauccaacaauagcuuuuucucucggcugaacuggcucacacaucugaaguuuaaauauccugcccuuaaugucaccaugcccaacaacgagaaguucgauaaacuguacaucuggggcgugcaccauccugggacggacaaugaucagauuuuucucuaugcgcaggccuccggacgcaucacaguuagcaccaagagaucccaacagacagugauuccgaacaucggcucucggccccgcgucagaaauauuccuagccggaucuccaucuacuggaccauugugaaacccggggacauccugcugauuaacagcaccggaaaucucaucgcuccucgcggcuacuucaagauuagaucugggaaguccagcaucaugcggucugaugcccccaucggaaaauguaacagcgaaugcauuacaccgaauggcuccaucccuaacgacaagcccuuucagaaugugaaccgcauuacguauggcgcuuguccuagauacgucaaacagaauacccugaagcuggccacagggaugcggaacguucccgagaaacaaacccgcggaaucuucggcgcgauugccggguuuaucgaaaauggaugggagggcaugguggacgggugguauggauucagacaccagaacucugagggcaucggccaggcugccgaucuuaagagcacacaagcugccauuaaucagaucaacgggaaacucaaccggcugauuggaaagaccaaugaaaaguuccaccagaucgagaaagaauuuuccgagguggaaggccgcauucaggaccuugagaaguacgucgaggauacgaaaaucgaccuguggagcuauaacgccgaacuccugguggcucuggagaaucaacauacaauugaucucaccgacucugaaaugaacaagcuguucgagagaaccaaaaagcagcuucgggaaaaugcggaggauauggggaacggaugcuuuaagaucuaccacaaaugugacaaugccugcaucggcuccauuagaaacgggacauaugaucaugacguuuaccgcgaugaggcucugaauaaccgguuccagaucaagggcguggaacucaaaagcggauacaaggacuggauucuguggaucucuuuugccauuuccugcuuccuucugugugucgcccucagcggcuuuaucaugugggcuugccagaaagggaauaucagauguaacauuugcaucuga

SEQ ID NO: 184781 - RNA, 1701 nt, Artificial Sequence
  derived and/or modified sequence opt5 from hemagglutinin__InfluenzaA__ABU92595
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggaggcaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauugaucagaucaaugggaaacucaaccggcugauuggaaagaccaacgaaaaguuccaccagaucgagaaagaauuuagcgagguggaaggccgcauucaggaccuugagaaguacgucgaggauacgaaaaucgaccugugguccuauaaugccgaacuccugguggcucuggagaaccaacauacaauugaucucaccgacagcgaaaugaauaagcuguucgagaaaaccaagaagcagcuuagagaaaacgcggaggauauggggaauggaugcuuuaaaaucuaccacaagugugacaacgccugcaucggcucuauucggaaugggacauaugaucaugacguuuacagagacgaggcucugaacaaucgcuuccagaucaaaggcguggaacucaaguccggauacaaagauuggauucuguggaucagcuuugccauuucuugcuuccuucugugugucgcccuccugggcuuuaucaugugggcuugccagaaggggaacauccgguguaauauuugcaucuga

SEQ ID NO: 184782 - RNA, 1701 nt, Artificial Sequence
  derived and/or modified sequence opt5 from hemagglutinin__InfluenzaA__ABU92596
augaagaccaucauugcccugagcuacauccucugccugguguucgcucagaaacuucccggcaacgacaauuccacagccacgcugugucucgggcaccaugcggucccuaacggaaccaugguuaagacaauuaccaaugaucaaaucgaggugacaaacgcuaccgaacuggugcagucuagcuccacaggcgagauuugcgacucuccgcaccagauccuugauggggaaaauuguacccugaucgacgcccuccugggagauccccagugcgacggcuuucaaaacaaaaagugggaucuguucgucgagagaagcaaagcccauuccaauuguuauccuuacgacgugcccgauuaugcuucucuccggagccugauugccuccagcgggacgcuugaauuuaacaaugagucuuucaacuggaccggaguuacacagaauggcaccuccagcgcuugcaagcgcagaucugacaacuccuuuuucagccggcugaauuggcucacacaccugaaguuuaaauacccugcccuuaacgugaccaugcccaauaacgaggaguucgauaagcuguauaucuggggcguccaucacccugggacggacaacgaucagauuucucucuacgcgcaggccuccggacgcaucacagugagcaccaaaagaucccaacagacaguuauuccgaauaucggcucucggccccgcgugagagacauuccuagccggaucuccaucuauuggaccauugucaagcccggggacauccugcugauuaacagcaccggaaaucucaucgcuccucgcggcuacuuuaaaauuagaucugggaaguccagcaucaugcggucugaugcccccaucggaaaguguaacagcggcugcauuacaccgaauggcuccaucccuaacgacaaacccuuccagaaugugaaccgcauuacguacggggcuuguccuagauaugugaagcagaauacccugaaacuugccacaggaaugcggaacguccccgaaaagcaaacccgcggcaucuuuggggcgauugccggauucaucgaaaauggcugggaggggaugguugauggaugguacggcuuuagacaccagaacucugagggcaucgggcaggcugccgaccugaaaagcacacaagcugccauugaucagaucaauggaaagcucaaccggcugauuggcaaaaccaaugaaaaguuccaucagaucgagaaggaguucuccgaaguggaagggcgcauucaggaccuugagaaauauguggaggauacgaagaucgaccuguggagcuacaacgccgaacuccuggucgcucuggagaaccaacacacaauugaucucaccgacucugaaaugaauaaacuguuugagagaaccaagaaacagcuucgggaaaacgcggaggauaugggaaauggcugcuucaagaucuaucauaagugugacaacgccugcaucggguccauuagaaauggcacauacgaccacgauguguaucgcgacgaggcucugaacaaucgguuucagaucaaaggaguugaacucaagagcggcuacaaagauuggauucuguggaucucuuucgccauuuccugcuuucuucuguguguggcccuccugggguucaucaugugggcuugccagaagggaaacaucagauguaauauuugcaucuga

SEQ ID NO: 184783 - RNA, 1701 nt, Artificial Sequence; identical to SEQ ID NO: 183654
  derived and/or modified sequence opt5 from hemagglutinin__InfluenzaA__ABU92597

SEQ ID NO: 184784 - RNA, 1701 nt, Artificial Sequence; identical to SEQ ID NO: 183097
  derived and/or modified sequence opt5 from hemagglutinin__InfluenzaA__ABU92601

SEQ ID NO: 184785 - RNA, 1701 nt, Artificial Sequence; identical to SEQ ID NO: 183097
  derived and/or modified sequence opt5 from hemagglutinin__InfluenzaA__ABU92602

SEQ ID NO: 184786 - RNA, 1701 nt, Artificial Sequence
  derived and/or modified sequence opt5 from hemagglutinin__InfluenzaA__ABU92603
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggccuccggacgcauuacaguuagcaccaaaagaucccaacagacagugaucccgaauauuggcucucggccccgcgucagagacgugagcucccggaucagcaucuacuggaccauugugaagccuggggauauccugcugauuaacucuaccggaaaccucaucgcuccccgcggcuauuucaagauuagauccgggaaaagcucuaucaugcggagcgacgccccuaucggaaaguguaauuccgaaugcauuacacccaacggcucuaucccgaaugauaaaccuuuucagaacgucaaucgcauuacguacggcgcuugucccagauauguuaagcagaacacccugaaacuugccacagggaugcggaaugugccugagaagcaaacccgcggaaucuucggcgcgauugccggguuuaucgaaaacggaugggagggcaugguggacgggugguacggauucagacaccagaauagcgagggcacaggccaggcugccgaucugaaauccacccaagcugccaucaaccagauuaaugggaagcucaaccggcugaucggaaagacgaaugaaaaauuucaccagauugagaaggaauuuagcgaggucgaaggcagaauccaggaccuugagaaauauguggaggauacaaagauugaccuguggucuuacaacgccgaacuccugguugcucuggagaaucaacauaccaucgaucucaccgacuccgaaaugaacaaacuguucgagcgcacaaagaagcagcuucgggaaaacgcggaggauauggggaauggaugcuuuaaaauuuaucacaagugugacaacgccugcaucggcagcaucagaaaugggaccuacgaccaugauguguaccgcgacgaggcucugaacaaucgguuccagauuaaaggcgucgaacucaagucuggauauaaagauuggauccuguggauuuccuuugccaucagcugcuuccuucuguguguggcccuccugggcuuuauuaugugggcuugccagaaggggaacaucagauguaauaucugcauuuga

SEQ ID NO: 184787 - RNA, 1701 nt, Artificial Sequence; identical to SEQ ID NO: 183097
  derived and/or modified sequence opt5 from hemagglutinin__InfluenzaA__ABU92604

SEQ ID NO: 184788 - RNA, 1701 nt, Artificial Sequence; identical to SEQ ID NO: 184786
  derived and/or modified sequence opt5 from hemagglutinin__InfluenzaA__ABU92605

SEQ ID NO: 184789 - RNA, 1701 nt, Artificial Sequence; identical to SEQ ID NO: 184786
  derived and/or modified sequence opt5 from hemagglutinin__InfluenzaA__ABU92606

SEQ ID NO: 184790 - RNA, 1701 nt, Artificial Sequence; identical to SEQ ID NO: 183636
  derived and/or modified sequence opt5 from hemagglutinin__InfluenzaA__ABU92608

SEQ ID NO: 184791 - RNA, 1701 nt, Artificial Sequence; identical to SEQ ID NO: 183636
  derived and/or modified sequence opt5 from hemagglutinin__InfluenzaA__ABU92609

SEQ ID NO: 184792 - RNA, 1701 nt, Artificial Sequence
  derived and/or modified sequence opt5 from hemagglutinin__InfluenzaA__ABU92610
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacauucuaaguuuaaauauccugcccugaaugucaccaugcccaacaacgagaaguucgacaaacuuuacaucuggggcgugcaccauccugggacggauaaugaccagauuuuucuguaugcgcaggccuccggacgcaucacaguuagcaccaagagaucccaacagacagugauuccgaacaucggcucucggccccgcgucagaaauauuccuagccggaucuccaucuacuggaccauugugaaacccggggauauccuccugauuaacagcaccggaaaucugaucgcuccucgcggcuacuucaagauuagaucugggaaguccagcaucaugcggucugacgcccccaucggaaaauguaacagcgaaugcauuacaccgaauggcuccaucccuaacgacaagcccuuucagaaugugaaccgcauugcuuauggcgccuguccuagauacgucaaacagaauacgcucaagcuggcgaccgggaugcggaacguucccgagaaacaaacacgcggaaucuucggcgccauugcuggguuuaucgaaaauggaugggagggcaugguggaugggugguauggauucagacaccagaacucugagggcaucggccaggccgcugaccuuaagagcacccaagccgccauuaaucagaucaacgggaaacugaaccggcucauuggaaagacaaaugaaaaguuccaccagaucgagaaagaauuuuccgagguggaaggccgcauucaggaucuggagaaguacgucgaggacaccaaaaucgaucuuuggagcuauaacgcugaacugcucguggcgcuggagaaucaacauacgauugaccugacagauucugaaaugaacaaacucuucgagagaaccaagaagcagcugcgggaaaaugccgaggacauguccaacgggugcuuuaagaucuaccacaaaugugauaaugcuugcaucggaagcauuagaaacggcaccuaugaccaugauguuuaccgcgacgaggcccuuaauaaccgguuccagaucaaggggguggaacugaaaucuggcuacaaggacuggauucucuggaucuccuuugccauuagcugcuuccugcuuugugucgugcugcucggauuuaucaugugggcuugccagaaaggcaauaucagauguaacauuugcaucuga

SEQ ID NO: 184793 - RNA, 1701 nt, Artificial Sequence
  derived and/or modified sequence opt5 from hemagglutinin__InfluenzaA__ABU92611
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucucucucuaugcgcaggccuccggcaaaauuacagugagcaccaagcgcucccaacagacaguuaucccgaacauugggucuagaccccgggugcgcgauaucccuagcagaaucuccauuuacuggaccaucgucaaacccggagacauucugcugaucaauagcaccggcaaccucauugcuccucggggguacuuuaagauccgcucuggaaaguccagcaucaugagaucugacgcccccauuggcaaauguaauagcgaaugcaucacaccgaacggcuccauuccuaaugauaagcccuuccagaacgugaaucggaucacguauggggcuuguccucgcuacgugaaacagaacacccugaagcuggccacaggaaugagaaauguccccgagaaacaaacccggggcauuuuuggggcgaucgccggauucaucgaaaacggcugggaggggaugguugacggaugguauggcuuucgccaccaaaauucugagggcauugggcaggcugccgaucuuaagagcacacaggcugccaucgaccagauuaacggaaaacucaauagacugaucggcaagaccaacgaaaaguuccaccagauugagaaagaguucuccgaaguggaagggcggauccaggaucuugagaaguacguggaggacacgaaaauugaucuguggagcuauaacgccgaacuccuggucgcucuggagaaucaacauacaaucgaccucaccgauucugaaaugaacaagcuguuugagagaaccaaaaagcagcuucgcgaaaaugcggaggacaugggaaacggcugcuucaagaucuaccacaaaugugauaaugccugcauuggguccauccggaacggcacauaugaccaugacguguacagagaugaggcucugaauaaccgcuuucagauuaagggaguugaacucaaaagcggcuacaaggacuggauccuguggauuucuuucgccaucuccugcuuucuucuguguguggcccuccugggguucaucauuugggcuugccugaaaggaaauauccgguguaacauuugcaucuga

SEQ ID NO: 184794 - RNA, 1701 nt, Artificial Sequence
  derived and/or modified sequence opt5 from hemagglutinin__InfluenzaA__ABU92612
augaagaccaucauugcccugagcuacauccucugccugguguucgcucagaaacuucccggcaacgacaauuccacagccacgcugugucucgggcaccaugcggucccuaacggaaccaugguuaagacaauuaccaaugaucaaaucgaggugacaaacgcuaccgaacuggugcagucuagcuccacaggcgggauuugcgacucuccgcaccagauccuugauggagagaauuguacccugaucgacgcccuccugggcgauccccagugcgacggguuucaaaacaaaaagugggaucuguucgucgaaagaagcaaagcccauuccaauuguuauccuuacgacgugcccgauuaugcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaccugaaguuuaaauacccugcccuuaaugucaccaugcccaacaacgagaaguucgacaaacuguauauuuggggagugcaucacccugggacggauaaugaccagaucucucucuacgcgcaggccuccggccgcauuacaguuagcaccaagagaucccaacagacagugaucccgaacauugggucucggccccgcgucagagauaucccuagccggauuuccaucuauuggaccaucgugaaacccggagacauucugcugaucaauagcaccggcaaccucauugcuccucgcggguacuuuaagaucagaucuggaaaguccagcauuaugcggucugacgcccccaucggcaaauguaauagcgagugcaucacaccgaacggcuccauuccuaauaacaagcccuuccagaaugugaaccgcaucacguacggggcuuguccuagauaugucaaacagaauacccugaagcuggccacaggaaugcggaacguucccgaaaaacaaacccgcggcauuuuuggggcgaucgccggauucauugagaauggcugggaagggaugguggauggaugguacggcuuuagacaccagaacucugagggcaucgggcaggcugccgaccuuaagagcacacaagcugccaucaaucagauuaacggaaaacucaaccggcugaucggcaagaccaaugagaaguuccaucagauugaaaaagaguucuccgaaguggaggggagaauccaggaucuugaaaaguaugucgaggacacgaaaauugaucuguggagcuacaacgccgagcuccugguggcucuggaaaaucaacacacaaucgaccucaccgauucugagaugaacaagcuguuugaacgcaccaaaaagcagcuucgggagaaugcggaagacaugggaaacggcugcuucaagauuuaucauaaaugugauaaugccugcaucggguccaucagaaacggcacauacgaccacgauguuuaucgcgacgaggcucugaauaaccgguuucagauuaagggaguggagcucaaaagcggcuacaaggacuggauccuguggauuucuuucgccaucuccugcuuucuucugugugucgcccuccugggguucauuaugugggcuugccagaaaggaaauaucagauguaacaucugcauuuga

SEQ ID NO: 184795 - RNA, 1701 nt, Artificial Sequence; identical to SEQ ID NO: 184282
  derived and/or modified sequence opt5 from hemagglutinin__InfluenzaA__ABU92613

SEQ ID NO: 184796 - RNA, 1701 nt, Artificial Sequence; identical to SEQ ID NO: 184781
  derived and/or modified sequence opt5 from hemagglutinin__InfluenzaA__ABU92614

SEQ ID NO: 184797 - RNA, 1701 nt, Artificial Sequence
  derived and/or modified sequence opt5 from hemagglutinin__InfluenzaA__ABU92615
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaagaaaugggaucuguucgucgaacggagcaaggccuauuccaauuguuacccuuaugacgugcccgauuacgcuucucuccgcagccugguugccuccagcggaacgcuugaguuuaacaaugaaucuuucaacuggaccggcgugacacagaauggcaccuccagcgcuugcaaaagacggucuaacaauuccuuuuucagccgccugaacuggcucacacaucugaaguuuaaguauccugcccuuaaugucaccaugcccaacaacgagaaauucgacaagcuguacaucuggggagugcaccauccugggacggauaaugaccagauuucucucuaugcgcaggccuccggcagaaucacaguuagcaccaaacggucccaacagacagugauuccgaacgucgggucucgccccagagugcgggauaucccuagccgcauuuccaucuacuggaccaucgugaagcccggagacauucugcugaucaauagcaccggcaaccucauugcuccuagaggguacuuuaaaauccggucuggaaaguccagcauuaugcgcucugacgcccccaucggcaaguguaauagcgagugcaucacaccgaacggcuccauuccuaaugauaaacccuuccagaacgucaauagaaucacguauggggcuuguccucgguacguuaagcagaacacccugaaacuugccacaggaaugcgcaaugugcccgaaaagcaaaccagaggcauuuuuggggcgaucgccggauucauugagaacggcugggaagggaugguggacggaugguauggcuuucggcaccaaaauucugagggcaucgggcaggcugccgaucugaaaagcacacaggcugccaucaaccagauuaauggaaagcucaacagacugaucggcaaaaccaacgagaaguuccaccagauugaaaaggaguucuccgaagucgaggggcgcauccaggaccuugaaaaauacguggaggauacgaagauugaccuguggagcuauaaugccgagcuccugguugcucuggaaaaccaacauacaaucgaucucaccgacucugagaugaauaaacuguuugaacggaccaagaaacagcuuagagagaacgcggaagauaugggaaauggcugcuucaagauuuaccacaagugugacaacgccugcaucggguccauccgcaauggcacauaugaucaugacguguaccgggacgaggcucugaacaauagauuucagauuaaaggagucgagcucaagagcggcuacaaagauuggauccuguggauuucuuucgccaucuccugcuuucuucuguguguggcccuccugggguucauuaugugggcuugccagaagggaaacauccgcuguaauaucugcauuuga

SEQ ID NO: 184798 - RNA, 1701 nt, Artificial Sequence
  derived and/or modified sequence opt5 from hemagglutinin__InfluenzaA__ABU92617
augaagaccaucauugcccugagcuacauccucugccugguguucgcucagaaacuucccggcaacgacaauuccacagccacgcugugucucgggcaccauucugucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgauuacgccagccuccggucccugaucgcuagcucuggaacgcuugaguuuaacaaugaauccuucaacuggaccggcguuacacagaauggcaccagcucugccugcaagcgcagauccaacagcucuuucuucucccggcugaauuggcucacacaucugaaguuuaaauauccugcucuuaacgugaccaugcccaauaacgaggaguucgacaagcuguacauuuggggaguccaccauccugggacggauaacgaccagaucagccucuaugcccaggcguccggccgcauuacagugucuaccaaaagaagccaacagacaguuaucccgaauauugggucccggccccgcgugagagauaucccuagccggaucucuauuuacuggaccaucgucaagcccggagacauucugcugaucaacuccaccggcaaucucauugccccucgcggguacuuuaaaaucagaagcggaaagucuagcaucaugcgguccgacgcucccauuggcaaguguaacucugaaugcaucacaccgaauggcagcauuccuaacgauaaacccuuccagaaugugaaccgcaucacguauggggccuguccuagauacgugaagcagaauacccugaaacuugcuacaggaaugcggaacguccccgagaagcaaacccgcggcauuuuuggggccaucgcgggauucaucgaaaauggcugggaggggaugguugacggaugguauggcuuuagacaccagaacuccgagggcauugggcaggccgcugaucugaaaagcacacaagccgcuaucgaccagauuaauggaaagcucaaccggcugaucggcaaaaccaaugaaaaguuccaccagauugagaaggaauuuucugagguggaagggagaauccaggaucuugagaaauacguggaggacacgaagauugaucugugguccuauaacgccgaacuccuggucgcccuggagaaccaacauacaaucgaccucaccgauagcgaaaugaauaaacuguuugagcgcaccaagaaacagcuucgggaaaacgcugaggacaugggaaauggcugcuucaagaucuaccacaagugugauaacgcgugcauugggucuaucagaaauggcacauaugaccaugacguguaccgcgaugaggcccugaacaaucgguuucagauuaaaggaguugaacucaaguccggcuacaaagacuggauccuguggauuagcuucgcuaucuccugcuuucuucuguguguggcccuccugggguucaucaugugggccugccagaagggaaacauuagauguaauaucugcauuuga

SEQ ID NO: 184799 - RNA, 1701 nt, Artificial Sequence; identical to SEQ ID NO: 184282
  derived and/or modified sequence opt5 from hemagglutinin__InfluenzaA__ABU92619

SEQ ID NO: 184800 - RNA, 1701 nt, Artificial Sequence; identical to SEQ ID NO: 184781
  derived and/or modified sequence opt5 from hemagglutinin__InfluenzaA__ABU92620

SEQ ID NO: 184801 - RNA, 1701 nt, Artificial Sequence
  derived and/or modified sequence opt5 from hemagglutinin__InfluenzaA__ABU92622
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacggauaacgaccagaucucccucuaugcgcaggccagcggccgcauuacaguguccaccaaaagaucucaacagacaguuaucccgaauauugggagccggccccgcgugagagauaucccuucccggaucagcauuuacuggaccaucgucaagcccggagacauucugcugaucaacucuaccggcaaucucauugcuccucgcggguacuuuaaaaucagauccggaaagagcucuaucaugcggagcgacgcccccauuggcaaguguaacuccgaaugcaucacaccgaauggcucuauuccuaacgauaaacccuuccagaaugugaaccgcaucacguauggggcuuguccuagaagcgugaagcagaauacccugaaacuugccacaggaaugcggaacguccccgagaagcaaacccgcggcauuuuuggggcgaucgccggauucaucgaaaauggcugggaggggaugguugacggaugguacggcuuuagacaccagaacuccgagggcauugggcaggcugccgaucugaaaagcacacaagcugccaucgaccagauuaauggaaagcucaaccggcugaucggcaaaaccaaugaaaaguuccaccagauugagaaggaguucucugaaguggaagggagaauccaggaucuugagaaauauguggaggacacgaagauugaucugugguccuacaacgccgaacuccuggucgcucuggagaaccaacauacaaucgaccucaccgauagcgaaaugaauaaacuguuugagcgcaccaagaaacagcuucgggaaaacgcggaggacaugggaaauggcugcuucaagaucuaucacaagugugauaacgccugcauugggucuaucagaaauggcacauacgaccaugacguguaucgcgaugaggcucugaacaaucgguuucagauuaaaggaguugaacucaaguccggcuacaaagacuggauccuguggauuagcuucgccaucuccugcuuucuucuguguguggcccuccugggguucaucaugugggcuugccagaagggaaacauuagauguaauaucugcauuuga

SEQ ID NO: 184802 - RNA, 1701 nt, Artificial Sequence; identical to SEQ ID NO: 183097
  derived and/or modified sequence opt5 from hemagglutinin__InfluenzaA__ABU92623

SEQ ID NO: 184803 - RNA, 1701 nt, Artificial Sequence
  derived and/or modified sequence opt5 from hemagglutinin__InfluenzaA__ABU92624
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggcccugggacgcauuacaguuuccaccaaaagaagccaacagacagugaucccgaauauuggcucccggccccgcgucagagacgugucuagccggaucuccaucuacuggaccauugugaagccuggggauauccugcucauuaacagcaccggaaaccugaucgcuccccgcggcuauuucaagauuagaucugggaaauccagcaucaugcggucugacgccccuaucggaaaguguaauagcgaaugcauuacacccaacggcuccaucccgaaugauaaaccuuuucagaacgucaaucgcauuacguacggcgcuugucccagauauguuaagcagaacacccuuaaacuggccacagggaugcggaaugugccugagaagcaaacccgcggaaucuucggcgcgauugccggguuuaucgaaaacggaugggagggcaugguggacgggugguacggauucagacaccagaauagcgagggcacaggccaggcugccgaucucaaaagcacccaagcugccaucaaccagauuaaugggaagcugaaccggcuuaucggaaagacgaaugaaaaauuucaccagauugagaaggaauuuuccgaggucgaaggcagaauccaggaccuggagaaauauguggaggauacaaagauugaccucuggagcuacaacgccgaacugcugguugcucucgagaaucaacauaccaucgaucugaccgacucugaaaugaacaaacuuuucgagcgcacaaagaagcagcugcgggaaaacgcggaggauauggggaauggaugcuuuaaaauuuaucacaagugugacaacgccugcaucggcuccaucagaaaugggaccuacgaccaugauguguaccgcgacgaggcucucaacaaucgguuccagauuaaaggcgucgaacugaagucuggauauaaagauuggauccuuuggauuucuuuugccaucuccugcuuccugcucuguguggcccugcugggcuuuauuaugugggcuugccagaaggggaacaucagauguaauaucugcauuuga

SEQ ID NO: 184804 - RNA, 1701 nt, Artificial Sequence; identical to SEQ ID NO: 184786
  derived and/or modified sequence opt5 from hemagglutinin__InfluenzaA__ABU92625

SEQ ID NO: 184805 - RNA, 1701 nt, Artificial Sequence; identical to SEQ ID NO: 183097
  derived and/or modified sequence opt5 from hemagglutinin__InfluenzaA__ABU92626

SEQ ID NO: 184806 - RNA, 1701 nt, Artificial Sequence
  derived and/or modified sequence opt5 from hemagglutinin__InfluenzaA__ABU92627
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagaucucuagcacaggcgagaucugcgacuccccgcaccagauucuggauggggaaaauuguacccuuaucgacgcccugcucggagauccccagugcgacggcuuucaaaacaaaaagugggaucuguucgucgagagaucuaaagccuauagcaauuguuacccuuaugacgugcccgauuacgcuucccugcggucucucguugccagcuccgggacgcuggaauuuaacaaugagagcuucgacuggaccggagugacacagaacggcaccucuuccgcuugcaagcgcagaagcgauaagucuuucuucucccggcuuaauuggcugacacaucucaaauauaaguacccugcccugaacgucaccaugcccaauaacgagaaauuugacaagcuguauauuuggggcgugcaccauccugggacggauagcgaccagaucucucuguacgcgcaggccuccggacgcauuacaguuagcaccaaaagaucccaacagacagugaucccgaauauuggcucucggccccgcgucagagacgugagcucccggaucagcaucuacuggaccauugugaagccuggggauauccuccugauuaaccgccccggaaaccugaucgcuccuagaggcuauuucaagauucggucugggaaauccagcaucaugcgcucugacgcccccaucggaaaguguaauagcgaaugcauuaccccgaacggcuccaucccuaaugauaaacccuuucagaacgucaauagaauuacauacggcgcuuguccucgguauguuaagcagaacacgcucaaacuggccaccgggaugcgcaaugugcccgagaagcaaacaagaggaaucuucggcgcgauugccggguuuaucgaaaacggaugggagggcaugguggacgggugguacggauuccggcaccaaaauucugagggcaccggccaggcugccgaucuuaaaagcacacaggcugccaucaaccagauuaaugggaagcugaacagacucaucggaaagaccaaugaaaaauuucaccagauugagaaggaauuuuccgaggucgaaggccgcauccaggaccuggagaaauauguggaggauacgaagauugaccuuuggagcuacaacgccgaacugcucguugcucuggagaaucaacauacaaucgaucugaccgacucugaaaugaacaaacucuucgagcggaccaagaagcagcugagagaaaacgcggaggauauggggaauggaugcuuuaaaauuuaucacaagugugacaacgccugcaucggcuccauccgcaaugggacauacgaccaugauguguaccgggacgaggcucuuaacaauagauuccagauuaaaggcgucgaacuuaagagcggauauaaagauuggauccucuggauuucuuuugccaucuccugcuuccugcuuuguguggcccugcucggcuuuauuaugugggcuugccagaaggggaacauccgcuguaauaucugcauuuga

SEQ ID NO: 184807 - RNA, 1701 nt, Artificial Sequence; identical to SEQ ID NO: 184786
  derived and/or modified sequence opt5 from hemagglutinin__InfluenzaA__ABU92628

SEQ ID NO: 184808 - RNA, 1701 nt, Artificial Sequence; identical to SEQ ID NO: 184786
  derived and/or modified sequence opt5 from hemagglutinin__InfluenzaA__ABU92631

SEQ ID NO: 184809 - RNA, 1701 nt, Artificial Sequence
  derived and/or modified sequence opt5 from hemagglutinin__InfluenzaA__ABU92632
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaaguccuuuuucagccggcugaauuggcucacacaucugaaauauaaguacccugcccuuaacgugaccaugcccaauaacgagaaauuugacaagcuguauauuuggggaguccaccauccugggacggauucugaccagaucucccucuacgcgcaggccagcggccgcauuacaguguccaccaaaagaucucaacagacaguuaucccgaacauugggagccggccccgcgugagagaugucuccagccggaucucuaucuacuggaccauugugaagccuggagacauccugcugauuaauuccaccggcaaccucaucgcuccccgcggguauuucaagauuagaagcggaaaaucuagcaucaugcgguccgacgccccuaucggcaaguguaauucugagugcauuacacccaacggcagcaucccgaaugauaaaccuuuucagaacgugaaucgcauuacguacggggcuugucccagauaugucaagcagaacacccugaaacuugccacaggaaugcggaauguuccugaaaagcaaacccgcggcaucuucggggcgauugccggauuuaucgagaacggcugggaagggaugguggacggaugguacggcuucagacaccucaauuccgagggcacagggcaggcugccgaucugaaaagcacccaggcugccaucaaccaaauuaauggaaagcugaaccggcuuaucggcaagacgaaugagaaauuucaccagauugaaaaggaguucucugaaguggaggggagaauccaggaccuggaaaaauaugucgaggauacaaagauugaccucugguccuacaacgccgagcugcugguggcucucgaaaaccagcauaccaucgaucugaccgacagcgagaugaauaaacuuuucgaacgcacaaagaagcaacugcgggagaacgcggaagauaugggaaauggcugcuuuaaaauuuaucacaagugugacaacgccugcaucgggucuaucagaaauggcaccuacgaucaugacguuuaccgcgacgaggcucucaacaaucgguuccagauuaaaggaguggagcugaaguccggcuauaaagauuggauccuuuggauuagcuuugccaucuccugcuuccugcucugugucgcccugcugggguuuauuaugugggcuugccagaagggaaacaucagauguaauaucugcauuuga

SEQ ID NO: 184810 - RNA, 1701 nt, Artificial Sequence
  derived and/or modified sequence opt5 from hemagglutinin__InfluenzaA__ABU92635
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagcaucguugccuccagcggaacgcuggaguuuaacaaugaaucuuucaacuggaccggcgugacacagaauggcaccuccagcgcuugcaagcgcaagucuaacaaauccuuuuucagcagacuuaauuggcugacacaucucaaguauaaauacccugcccugaacgucaccaugcccaauaacgagaaguuugacaaacuuuauauuuggggagugcaccauccugggacggauaacgaccagaucucucuguacgcgcaggccuccggccggauuacaguuagcaccaagcgcucccaacagacagugaucccgaauauugggucuagaccccggguccgcgaugugagcuccagaaucagcaucuacuggaccauugugaagccuggagacauccuccugauuaacucuaccggcaaucugaucgcuccccggggguauuucaaaauucgcuccggaaagagcucuaucaugagaagcgacgccccuaucggcaaauguaacuccgagugcauuacacccaauggcucuaucccgaacgauaagccuuuucagaaugucaaccggauuacguacggggcuuguccccgcuauguuaaacagaauacccucaagcuggccacaggaaugagaaacgugccugaaaaacaaacccggggcaucuucggggcgauugccggauuuaucgagaauggcugggaagggaugguggacggaugguacggcuuccgccaccagaacagcgagggcacagggcaggcugccgaucuuaaguccacccaagcugccaucaaucagauuaacggaaagcugaauagacucaucggcaaaacgaacgagaaguuucaccagauugaaaaagaguucagcgaagucgaggggcggauccaggaccuggaaaaguauguggaggauacaaaaauugaccuuuggucuuacaacgccgagcugcucguugcucuggaaaaucaacauaccaucgaucugaccgacuccgagaugaacaaacucuucgaaagaacaaagaagcagcugcgcgagaaugcggaagauaugggaaacggcugcuuuaagauuuaucacaaaugugacaaugccugcaucgggagcauccggaacggcaccuacgaucaugacguguacagagacgaggcucuuaauaaccgcuuccagauuaagggagucgagcugaaaucuggcuauaaggauuggauccucuggauuuccuuugccaucagcugcuuccugcuuuguguggcccugcucggguuuauuaugugggcuugccagaagggaaauauccgguguaacaucugcauuuga

SEQ ID NO: 184811 - RNA, 1701 nt, Artificial Sequence; identical to SEQ ID NO: 183654
  derived and/or modified sequence opt5 from hemagglutinin__InfluenzaA__ABU92636

SEQ ID NO: 184812 - RNA, 1701 nt, Artificial Sequence
  derived and/or modified sequence opt5 from hemagglutinin__InfluenzaA__ABU92637
augaagaccaucauugcccugagcuacauccucugccugguguucgcucagaaacuucccggcaacgacaauuccacagccacgcugugucucgggcaccaugcggucccuaacggaaccacaguuaagaccauuacaaaugaucaaaucgaggugaccaacgcuacagaacuggugcagucuagcuccaccggcgggauuugcgacucuccgcaccagauccuugauggagagaauuguacgcugaucgacgcccuccugggcgauccccagugcgacggguuucaaaacaaaaagugggaucuguucgucgaaagaagcaaagccuauuccaauuguuacccuuaugacgugcccgauuacguuucucuccggagccugguggcuuccagcggaacccuugaguuuaacaaugaaucuuucaacuggacaggcgucacccagaauggcacauccagcgccugcaagcgcagaucuaacaauuccuuuuucagccggcugaacuggcucacccaucugaaguuuaaauauccugcucuuaaugugacgaugcccaacaacgagaaguucgacaaacuguacauuuggggaguucaccauccugggacagauaaugaccagaucucucucuaugcccaggcguccggccgcauuaccgugagcacaaagagaucccaacagaccgucaucccgaacauugggucucggccccgcgugagagauaucccuagccggauuuccaucuacuggaccaucgugaaacccggagacauucugcugaucaauagcacaggcaaccucauugccccucgcggguacuuuaagaucagaucuggaaaguccagcauuaugcggucugacgcucccaucggcaaauguaauagcgagugcaucacgccgaacggcuccauuccuaaugauaagcccuuccagaacgucaaucgcaucaccuauggggccuguccuagauacguuaaacagaacacacugaaacuugcuaccggaaugcggaaugugcccgaaaaacaaacacgcggcauuuuuggggccaucgcgggauucauugagaacggcugggaagggaugguggacggaugguauggcuuuagacaccagaauagcgagggcaucgggcaggccgcugaucugaagucuacccaagccgcuaucaaccagauuaauggaaaacucaaccggcugaucggcaagacgaacgagaaguuccaccagauugaaaaagaguucuccgaagucgaggggagaauccaggaccuugaaaaguacguggaggauacaaaaauugaccuguggagcuauaaugccgagcuccugguugcccuggaaaaccaacauaccaucgaucucaccgacucugagaugaauaagcuguuugaacgcacaaagaagcagcuucgggagaacgcugaagauaugggaaauggcugcuucaagauuuaccacaaaugugacaacgcgugcaucggguccaucagaaauggcaccuaugaucaugacguguaccgcgacgaggcccugaacaaucgguuucagauuaagggagucgagcucaaaagcggcuacaaggauuggauccuguggauuucuuucgcuaucuccugcuuucuucuguguguggcccuccugggguucauuaugugggccugccagaaaggaaacaucagauguaauaucugcauuuga

SEQ ID NO: 184813 - RNA, 1701 nt, Artificial Sequence
  derived and/or modified sequence opt5 from hemagglutinin__InfluenzaA__ABU92639
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacacgaaaugggaucuguucgucgagagaucuaaggccuauagcaauuguuacccuuaugacgugcccgauuacgcuucccuccggucucugguugccagcuccgggacccuugaauuuaacaaugagagcuucgacuggacaggagugacccagaacggcacaucuuccgcuugcaaacgcagaagcgauaagucuuucuucucccggcugaauuggcucacccaucugaaguauaaauacccugcccuuaacgucacgaugcccaauaacgagaaguuugacaaacuguauauuuggggcgugcaccauccugggacagauagcgaccagaucucucucuacgcgcaggccuccggacgcauuaccguuagcacaaagagaucccaacagaccgugaucccgaauauuggcucucggccccgcgucagagacgugagcucccggaucagcaucuacuggaccauugugaaaccuggggauauccugcugauuaacucuacaggaaaccucaucgcuccccgcggcuauuucaagauuagauccggaaagagcucuaucaugcggagcgacgccccuaucgggaaauguaauuccgaaugcauuacgcccaacggcucuaucccgaaugauaagccuuuucagaacgucaaucgcauuaccuacggcgcuugucccagauauguuaaacagaacacacugaaacuugccaccgggaugcggaaugugccugagaagcaaacacgcggaaucuucggcgcgauugccggguuuaucgaaaacggaugggagggcaugguggacgggugguacggauucagacaccagaauagcgagggcaccggccaggcugccgaucugaaguccacgcaagcugccaucaaccagauuaaugggaaacucaaccggcugaucggaaagacaaaugaaaaguuucaccagauugagaaagaauuuagcgaggucgaaggcagaauccaggaccuugagaaguauauugaggauaccaaaaucgaccuguggucuuacaacgccgaacuccugguggcucuggagaaucaacauaccauugaucucacagacuccgaaaugaacaagcuguucgagcgcaccaaaaagcagcuucgggaaaacgcggaggauauggggaauggaugcuuuaagaucuaucacaaaugugacaacgccugcaucggcagcauuagaaaugggacauacgaccaugauguuuaccgcgacgaggcucugaacaaucgguuccagaucaagggcguggaacucaaaucuggauauaaggauuggauucuguggaucuccuuugccauuagcugcuuccuucugugugucgcccuccugggcuuuaucaugugggcuugccagaaagggaacaucagauguaauauuugcaucuga

SEQ ID NO: 184814 - RNA, 1701 nt, Artificial Sequence
  derived and/or modified sequence opt5 from hemagglutinin__InfluenzaA__ABU92640
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauuaaucagaucaacgggaaacucaaccggcugauuggaaagaccaaugaaaaguuccaccagaucgagaaagaauuuagcgagguggaaggccgcauucaggaucuugagaaguacgucgaggacacgaaaaucgaucugugguccuauaacgccgaacuccugguggcucuggagaaucaacauacaauugaccucaccgauagcgaaaugaacaagcuguucgagagaaccaaaaagcagcuucgggaaaaugcggaggacauggggaacggaugcuuuaagaucuaccacaaaugugauaaugccugcaucggcucuauuagaaacgggacauaugaccaugauguuuaccgcgacgaggcucugaauaaccgguuccagaucaagggcguggaacucaaauccggauacaaggacuggauucuguggaucagcuuugccauuucuugcuuccuucugugugccgcucuccugggcuuuaucaugugggccugccagaaagggaauaucagauguaacauuugcaucuga

SEQ ID NO: 184815 - RNA, 1701 nt, Artificial Sequence
  derived and/or modified sequence opt5 from hemagglutinin__InfluenzaA__ABU92641
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcaagucuaacaauuccuuuuucagcagacugaacuggcucacacaucugaaauuuaaguauccugcccuuaaugucaccaugcccaacaacgagaaauucgacaagcuguacaucuggggagugcaccauccugggacggauaaugaccagauuucucucuaugcgcaggccuccggccggaucacaguuagcaccaaacgcucccaacagacagugauuccgaacaucgggucuagaccccggguccgcgauauuccuagcagaaucuccaucuacuggaccauugugaagcccggagacauccugcugauuaauagcaccggcaaccucaucgcuccucggggguacuuuaagauucgcucuggaaaauccagcaucaugagaucugacgcccccaucggcaaguguaauagcgagugcauuacaccgaacggcuccaucccuaaugauaaacccuuccagaacgugaaucggauuacguauggggcuuguccucgcuacgucaagcagaacacccugaaacuugccacaggaaugagaaauguucccgaaaagcaaacccggggcaucuuuggggcgauugccggauucaucgagaacggcugggaagggaugguggacggaugguauggcuuucgccaccaaaauucugagggcaucgggcaggcugccgaucugaaaagcacacaggcugccauuaaccagaucaauggaaagcucaacagacugauuggcaagaccaacgagaaauuccaccagaucgaaaaggaguucuccgaaguggaggggcggauucaggaccuugaaaaauacgucgaggauacgaagaucgaccuguggagcuauaaugccgagcuccugguggcucuggaaaaccaacauacaauugaucucaccgacucugagaugaauaaacuguuugaaagaaccaagaagcagcuucgcgagaacgcggaagauaugggaaauggcugcuucaaaaucuaccacaagugugacaacgccugcaucggguccauucggaauggcacauaugaucaugacguuuacagagacgaggcucugaacaaucgcuuucagaucaaaggaguggagcucaagagcggcuacaaagauuggauucuguggaucucuuucgccauuuccugcuuucuucugugugucgcccuccugggguucaucaugugggcuugccagaagggaaacauccgguguaauauuugcaucuga

SEQ ID NO: 184816 - RNA, 1701 nt, Artificial Sequence
  derived and/or modified sequence opt5 from hemagglutinin__InfluenzaA__ABU92642
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucauuguuuccacaaagagaagccaacagaccgugaucccgaacauugggucccggccccgcgucagaaauaucccuucucggaucagcauuuacuggacaaucgugaaacccggagauauucugcugaucaacuccaccggcaaucucauugcuccucgcggguacuucaagaucagaagcggaaagucuuccaucaugcggagcgacgcccccauuggcaaauguaacucugagugcaucaccccgaauggcagcauuccuaacgacaagcccuuucagaaugugaaccgcaucacauauggggcuuguccuagauacgucaaacagaauacgcugaaacuugccaccggaaugcggaacguucccgaaaaacaaacacgcggcauuuucggggcgaucgccggauuuaucgagaauggcugggaagggaugguggauggaugguauggcuucagacaccagaacuccgagggcauugggcaggcugccgaccugaagucuacccaagcugccaucgaucagauuaauggaaaacucaaccggcugaucggcaagacaaacgagaaguuccaccagauugaaaaagaguuuagcgaaguggaggggagaauccaggaccuugaaaaguacgucgaggauaccaaaauugaccugugguccuauaaugccgagcuccugguggcucuggaaaaccaacauacgaucgaucucacagacagcgagaugaauaagcuguucgaaaagaccaagaagcagcuucgcgagaacgcggaagauaugggaaauggcugcuuuaaaaucuaccacaagugugacaacgccugcauugggucuauccggaauggcaccuaugaucaugacguuuacagagacgaggcucugaacaaucgcuuccagauuaaaggaguggagcucaaguccggcuacaaagauuggauccuguggauuagcuuugccaucucuugcuuccuucugugugucgcccuccugggguuuaucaugugggcuugccagaagggaaacauucgguguaauaucugcauuuga

SEQ ID NO: 184817 - RNA, 1701 nt, Artificial Sequence
  derived and/or modified sequence opt5 from hemagglutinin__InfluenzaA__ABU92643
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggccuccggacgcauuacaguuagcaccaaaagaucccaacagacagugaucccgaauauuggcucucggccccgcgucagagacgugagcucccggaucagcaucuacuggaccauugugaagccuggggauauccugcugauuaacucuaccggaaaccucaucgcuccccgcggcuauuucaagauuagauccgggaaaagcucuaucaugcggagcgacgccccuaucggaaaguguaauuccgaaugcauuacacccaacggcucuaucccgaaugauaaaccuuuucagaacgucaaucgcauuacguacggcgcuugucccagauauguuaagcagaacacccugaaacuugccacagggaugcggaaugugccugagaagcaaacccgcggaaucuucggcgcgauugccggguuuaucgaaaacggaugggagggcaugguggacgggugguacggauucagacaccagaauagcgagggcacaggccaggcugccgaucugaaauccacccaagcugccaucaaccagauuaaugggaagcucaaccggcugaucggaaagacgaaugaaaaauuucaccagauugagaaggaauuuagcgaggucgaaggcagaauccaggaccuugagaaauauguggaggauacaaagauugaccuguggucuuacaacgccgaacuccugguugcucuggagaaucaacauaccaucgaucucaccgacuccgaaaugaacaaacuguucgagcgcacaaagaagcagcuucgggaaaacgcggaggauauggggaauggaugcuuuaaaauuuaucacaagugugacaacgccugcaucggcagcaucagaaaugggaccuacgaccauaacguguaccgcgaugaggcucugaauaaccgguuccagauuaaaggcgucgaacucaagucuggauauaaagacuggauccuguggauuuccuuugccaucagcugcuuccuucuguguguggcccuccugggcuuuauuaugugggcuugccagaaggggaauaucagauguaacaucugcauuuga

SEQ ID NO: 184818 - RNA, 1701 nt, Artificial Sequence
  derived and/or modified sequence opt5 from hemagglutinin__InfluenzaA__ABU92645
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauugcuuauggcgccuguccuagauacgucaaacagaauacgcugaaacuugcgaccgggaugcggaacguucccgagaagcaaacacgcggaaucuucggcgccauugcuggguuuaucgaaaauggaugggagggcaugguggaugggugguauggauucagacaccagaacuccgagggcaucggccaggccgcugaccugaagucuacccaagccgccauuaaucagaucaacgggaaacucaaccggcugauuggaaagacaaaugaaaaguuccaccagaucgagaaagaauuuagcgagguggaaggccgcauucaggaucuugagaaguacgucgaggacaccaaaaucgaucugugguccuauaacgcugaacuccugguggcgcuggagaaucaacauacgauugaccucacagauagcgaaaugaacaagcuguucgagagaaccaaaaagcagcuucgggaaaaugccgaggacauggggaacggaugcuuuaagaucuaccacaaaugugauaaugcuugcaucggcucuauuagaaacgggaccuaugaccaugauguuuaccgcgacgaggcccugaauaaccgguuccagaucaagggcauugaacucaaauccggauacaaggacuggauccuguggauuagcuuugccaucucuugcuuccuucugugugugguccuccugggcuuuaucaugugggcuugccagaaagggaauauuagauguaacaucugcauuuga

SEQ ID NO: 184819 - RNA, 1701 nt, Artificial Sequence
  derived and/or modified sequence opt5 from hemagglutinin__InfluenzaA__ABU92646
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuaagcagaauacccugaaacuugccacaggaaugcggaacgugcccgaaaagcaaacccgcggcauuuuuggggcgaucgccggauucauugagaauggcugggaagggaugguggacggaugguauggcuuuagacaccagaacucugagggcacagggcaggcugccgaucugaaaagcacccaagcugccaucaaucagaucaacggaaagcucaaucggcugauuggcaagacgaacgagaaauuccaccagaucgaaaaggaguucuccgaagucgaggggcgcauucaggaccuugaaaaauacguggaggauacaaagaucgaccuguggagcuauaacgccgagcuccugguugcucuggaaaaucaacauaccauugaucucaccgacucugagaugaacaaacuguuugaaagaacaaagaagcagcuucgggagaaugcggaagauaugggaaacggcugcuucaaaaucuaccacaagugugacaaugccugcauuggguccaucagaaacggcaccuaugaucaugacguguaccgcgacgaggcucugaauaaccgguuucagaucaaaggagucgagcucaagagcggcuacaaagauuggauucuguggaucucuuucgccauuuccugcuuucuucuguguguggcccuccugggguucaucaugugggcuugccagaagggaaauauuagauguaacaucugcaucuga

SEQ ID NO: 184820 - RNA, 1701 nt, Artificial Sequence; identical to SEQ ID NO: 183097
  derived and/or modified sequence opt5 from hemagglutinin__InfluenzaA__ABU92647

SEQ ID NO: 184821 - RNA, 1701 nt, Artificial Sequence
  derived and/or modified sequence opt5 from hemagglutinin__InfluenzaA__ABU92648
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucaacuggaccggagugacacagaauggcaccucuuccgcuugcaagcgcagaagcgacaagucuuucuucucccggcugaacuggcucacacaucugaaauauaaguacccugcccuuaaugucaccaugcccaacaaugagaaauuugauaagcuguauauuuggggcgugcaccauccugggacggacagcgaucagaucucucucuacgcgcaggccuccggacgcauuacaguuagcaccaaaagaucccaacagacagugaucccgaacauuggcucucggccccgcgucagagacgugagcucccggaucagcaucuacuggaccauugugaagccuggggacauccugcugauuaacucuaccggaaaucucaucgcuccccgcggcuauuucaagauuagauccgggaaaagcucuaucaugcggagcgaugccccuaucggaaaguguaacuccgaaugcauuacacccaauggcucuaucccgaacgacaaaccuuuucagaaugucaaccgcauuacguacggcgcuugucccagauauguuaagcagaauacccugaaacuugccacagggaugcggaacgugccugagaagcaaacccgcggaaucuucggcgcgauugccggguuuaucgaaaauggaugggagggcaugguggaugggugguacggauucagacaccagaacagcgagggcacaggccaggcugccgaccugaaauccacccaagcugccaucaaucagauuaacgggaagcucaaucggcugaucggaaagacgaacgaaaaauuucaccagauugagaaggaauuuagcgaggucgaaggcagaauccaggaucuugagaaauauguggaggacacaaagauugaucuguggucuuacaaugccgaacuccugguugcucuggagaaccaacauaccaucgaccucaccgauuccgaaaugaacaaacuguucgagcgcacaaagaagcagcuucgggaaaaugcggaggacauggggaacggaugcuuuaaaauuuaucacaagugugauaaugccugcaucggcagcaucagaaacgggaccuacgaccaugacguguaccgcgaugaggcucugaauaaccgguuccagauuaaaggcgucgaacucaagucuggauauaaagacuggauccuguggauuuccuuugccaucagcugcuuccuucuguguguggcccuccugggcuuuauuaugugggcuugccagaaggggaauaucagauguaacaucugcauuuga

SEQ ID NO: 184822 - RNA, 1701 nt, Artificial Sequence; identical to SEQ ID NO: 183097
  derived and/or modified sequence opt5 from hemagglutinin__InfluenzaA__ABU92649

SEQ ID NO: 184823 - RNA, 1701 nt, Artificial Sequence; identical to SEQ ID NO: 184786
  derived and/or modified sequence opt5 from hemagglutinin__InfluenzaA__ABU92650

SEQ ID NO: 184824 - RNA, 1701 nt, Artificial Sequence
  derived and/or modified sequence opt5 from hemagglutinin__InfluenzaA__ABU92651
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuuauaacgagagcuucgacuggaccggagugacacagaauggcaccucuuccgcuugcaagcgcagaagcgauaagucuuucuucucccggcugaacuggcucacacaucugaaauacaaguauccugcccuuaaugucaccaugcccaacaaugagaaauuugacaagcuguacauuuggggcgugcaccauccugggacggauagcgaccagaucucucucuacgcgcaggccuccggacgcauuacaguuagcaccaaaagaucccaacagacagugaucccgaacauuggcucucggccccgcgucagagacgugagcucccggaucagcaucuauuggaccauugugaagccuggggauauccugcugauuaauucuaccggaaaccucaucgcuccccgcggcuacuucaagauuagauccgggaaaagcucuaucaugcggagcgacgccccuaucggaaaguguaacuccgaaugcauuacacccaauggcucuaucccgaacgauaaaccuuuucagaaugucaaccgcauuacguauggcgcuugucccagauacguuaagcagaauacccugaaacuugccacagggaugcggaacgugccugagaagcaaacccgcggaaucuucggcgcgauugccggguuuaucgaaaauggaugggagggcaugguggacgggugguauggauucagacaccagaacagcgagggcacaggccaggcugccgaucugaaauccacccaagcugccaucaaucagauuaacgggaagcucaaucggcugaucggaaagacgaacgaaaaauuucaccagauugagaaggaauuuagcgaggucgaaggcagaauccaggaccuugagaaauacguggaggauacaaagauugaccuguggucuuauaaugccgaacuccugguugcucuggagaaccaacauaccaucgaucucaccgacuccgaaaugaauaaacuguucgagcgcacaaagaagcagcuucgggaaaacgcggaggauauggggaacggaugcuuuaaaauuuaccacaagugugacaaugccugcaucggcagcaucagaaacgggaccuacgaccaugauguguaucgcgacgaggcucugaauaaccgguuccagauuaaaggcgucgaacucaagucuggauacaaagauuggauccuguggauuuccuuugccaucagcugcuuccuucuguguguggcccuccugggcuuuauuaugugggcuugccagaaggggaauaucagauguaacaucugcauuuga

SEQ ID NO: 184825 - RNA, 1701 nt, Artificial Sequence
  derived and/or modified sequence opt5 from hemagglutinin__InfluenzaA__ABU92652
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaucggaaacggcugcuuuaaaauuuaucacaagugugauaaugccugcaucgggucuaucagaaacggcaccuacgaccaugacguguaccgcgaugaggcucugaauaaccgguuccagauuaaaggagucgagcucaaguccggcuauaaagacuggauccuguggauuagcuuugccaucuccugcuuccuucuguguguggcccuccugggguuuauuaugugggcuugccagaagggaaauaucagauguaacaucugcauuuga

SEQ ID NO: 184826 - RNA, 1701 nt, Artificial Sequence; identical to SEQ ID NO: 184786
  derived and/or modified sequence opt5 from hemagglutinin__InfluenzaA__ABU92653

SEQ ID NO: 184827 - RNA, 1701 nt, Artificial Sequence
  derived and/or modified sequence opt5 from hemagglutinin__InfluenzaA__ABU92654
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggcaaaaucacaguuagcaccaagcgcucccaacagacagugauuccgaauaucgggucuagaccccggguccgcgaugugccuagcagaauuuccaucuacuggaccaucgugaagcccggagacauucugcugaucaacagcaccggcaaucucauugcuccucggggguacuuuaaaauccgcucuggaaaguccagcauuaugagaucugacgcccccaucggcaaauguaacagcgagugcaucacaccgaauggcuccauucugaacgauaagccuuuccagaaugucaaccggaucacguauggggcuuguccccgcuacguuaaacagaauacccuuaagcuggccacaggaaugagaaacgugccugaaaaacaaacccggggcauuuuuggggcgaucgccggauucauugagaauggcugggaagggaugguggacggaugguauggcuuucgccaccagaacgcugagggcacagggcaggccgcugaucucaagucuacccaagccgccaucaaucagaucaacggaaagcugaauagacuuauuggcaaaacgaacgagaaguuccaccagaucgaaaaagaguucagcgaagucgaggggcggauucaggaccuggaaaaguacguggaggauacaaaaaucgaccucugguccuauaacgcugagcugcugguugcgcucgaaaaucaacauaccauugaucugaccgacagcgagaugaacaaacuuuuugaaagaacaaagaagcagcugcgcgagaaugccgaagauaugggaaacggcugcuucaagaucuaccacaaaugugacaaugcuugcauugggucuauccggaacggcaccuaugaucaugacguguacagagacgaggcccucaauaaccgcuuucagaucaagggagucgagcugaaauccggcuacaaggauuggauucuuuggaucagcuucgccauuucuugcuuucugcucuguguggcucugcugggguucaucaugugggccugccagaagggaaauauucgguguaacaucugcaucuga

SEQ ID NO: 184828 - RNA, 1701 nt, Artificial Sequence
  derived and/or modified sequence opt5 from hemagglutinin__InfluenzaA__ABU92655
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuaagcagaauacccugaaacuugccacaggaaugcggaacgugcccgaaaagcaaacccgcggcauuuuuggggcgaucgccggauucauugagaauggcugggaagggaugguggacggaugguauggcuuuagacaccagaacgcugagggcacagggcaggccgcugaucugaaaucuacccaagccgccaucaaucagaucaacggaaagcucaaucggcugauuggcaagacgaacgagaaauuccaccagaucgaaaaggaguucagcgaagucgaggggcgcauucaggaccuugaaaaauacguggaggauacaaagaucgaccugugguccuauaacgcugagcuccugguugcgcuggaaaaucaacauaccauugaucucaccgacagcgagaugaacaaacuguuugaaagaacaaagaagcagcuucgggagaaugccgaagauaugggaaacggcugcuucaaaaucuaccacaagugugacaaugcuugcauugggucuaucagaaacggcaccuaugaucaugacguguaccgcgacgaggcccugaauaaccgguuucagaucaaaggagucgagcucaaguccggcuacaaagauuggauucuguggaucagcuucgccauuucuugcuuucuucuguguguggcucuccugggguucaucaugugggccugccagaagggaaauauuagauguaacaucugcaucuga

SEQ ID NO: 184829 - RNA, 1701 nt, Artificial Sequence; identical to SEQ ID NO: 184786
  derived and/or modified sequence opt5 from hemagglutinin__InfluenzaA__ABU92656

SEQ ID NO: 184830 - RNA, 1701 nt, Artificial Sequence; identical to SEQ ID NO: 183657
  derived and/or modified sequence opt5 from hemagglutinin__InfluenzaA__ABU92657

SEQ ID NO: 184831 - RNA, 1701 nt, Artificial Sequence; identical to SEQ ID NO: 184786
  derived and/or modified sequence opt5 from hemagglutinin__InfluenzaA__ABU92658

SEQ ID NO: 184832 - RNA, 1701 nt, Artificial Sequence; identical to SEQ ID NO: 183657
  derived and/or modified sequence opt5 from hemagglutinin__InfluenzaA__ABU92659

SEQ ID NO: 184833 - RNA, 1701 nt, Artificial Sequence; identical to SEQ ID NO: 184786
  derived and/or modified sequence opt5 from hemagglutinin__InfluenzaA__ABU92660

SEQ ID NO: 184834 - RNA, 1701 nt, Artificial Sequence
  derived and/or modified sequence opt5 from hemagglutinin__InfluenzaA__ABU92661
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggccuccggacgcauuacaguuagcaccaaaagaucccaacagacagugaucccgaauauuggcucucggccccgcgucagagacgugagcucccggaucagcaucuacuggaccauugugaagccuggggauauccugcugauuaacucuaccggaaaccucaucgcuccccgcggcuauuucaagauuagauccgggaaaagcucuaucaugcggagcgacgccccuaucggaaaguguaauuccgaaugcauuacacccaacggcucuaucccgaaugauaaaccuuuucagaacgucaaucgcauuacguacggcgcuugucccagauauguuaagcagaacacccugaaacuugccacagggaugcggaaugugccugagaagcaaacccgcggaaucuucggcgcgauugccggguuuaucgaaaacggaugggagggcaugguggacgggugguacggauucagacaccagaauagcgagggcacaggccaggcugccgaucugaaauccacccaagcugccaucaaccagauuaaugggaagcucaaccggcugaucggaaagacgaaugaaaaauuucaccagauugagaaggaauuuagcgaggucgaaggcagaauccaggaccuugagaaauauguggaggauacaaagauugaccuguggucuuacaacgccgaacuccugguugcucuggagaaucaacauaccaucgaucucaccgacuccgaaaugaacaaacuguucgagcgcacaaagaagcagcuucgggaaaacgcggaggauauggggaauggaugcuuuaaaauuuaucacaagugugacaacgccugcaucggcagcaucagaaaugggaccuacgaccaugauguguaccgcgacgaggcucugaacaaucgguuccagauuaaaggcgucgaacucgagucuggauauaaggauuggauccuguggauuuccuuugccaucagcugcuuccuucuguguguggcccuccugggcuuuauuaugugggcuugccagaaagggaacaucagauguaauaucugcauuuga

SEQ ID NO: 184835 - RNA, 1701 nt, Artificial Sequence; identical to SEQ ID NO: 183097
  derived and/or modified sequence opt5 from hemagglutinin__InfluenzaA__ABU92662

SEQ ID NO: 184836 - RNA, 1701 nt, Artificial Sequence; identical to SEQ ID NO: 184786
  derived and/or modified sequence opt5 from hemagglutinin__InfluenzaA__ABU92663

SEQ ID NO: 184837 - RNA, 1701 nt, Artificial Sequence; identical to SEQ ID NO: 184786
  derived and/or modified sequence opt5 from hemagglutinin__InfluenzaA__ABU92664

SEQ ID NO: 184838 - RNA, 1701 nt, Artificial Sequence
  derived and/or modified sequence opt5 from hemagglutinin__InfluenzaA__ABU92665
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuacccagaauacacugaagcuggccaccggaaugcggaacgugcccgaaaaacaaacacgcggcauuuuuggggcgaucgccggauucauugagaauggcugggaagggaugguggacggaugguauggcuuuagacaccagaacucugagggcaccgggcaggcugccgaucuuaagagcacgcaagcugccaucaaucagaucaacggaaaacucaaucggcugauuggcaagacaaacgagaaguuccaccagaucgaaaaagaguucuccgaagucgaggggcgcauucaggaccuugaaaaguacguggaggauaccaaaaucgaccuguggagcuauaacgccgagcuccugguugcucuggaaaaucaacauaccauugaucucacagacucugagaugaacaagcuguuugaaagaaccaaaaagcagcuucgggagaaugcggaagauaugggaaacggcugcuucaagaucuaccacaaaugugacaaugccugcauuggguccaucagaaacggcacauaugaucaugacguguaccgcgacgaggcucugaauaaccgguuucagaucaagggagucgagcucaaaagcggcuacaaggauuggauucuguggaucucuuucgccauuuccugcuuucuucuguguguggcccuccugggguucaucaugugggcuugccagaaaggaaauauuagauguaacaucugcaucuga

SEQ ID NO: 184839 - RNA, 1701 nt, Artificial Sequence; identical to SEQ ID NO: 184786
  derived and/or modified sequence opt5 from hemagglutinin__InfluenzaA__ABU92666

SEQ ID NO: 184840 - RNA, 1701 nt, Artificial Sequence; identical to SEQ ID NO: 183096
  derived and/or modified sequence opt5 from hemagglutinin__InfluenzaA__ABU92667

SEQ ID NO: 184841 - RNA, 1701 nt, Artificial Sequence; identical to SEQ ID NO: 183096
  derived and/or modified sequence opt5 from hemagglutinin__InfluenzaA__ABU92668

SEQ ID NO: 184842 - RNA, 1701 nt, Artificial Sequence
  derived and/or modified sequence opt5 from hemagglutinin__InfluenzaA__ABU92669
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggagcacggccuauuccaauuguuacccuuaugacguucccgauuacgcuucucugcgcagccuuguggccuccagcggcacccuggaauuuaacaaugagucuuucaacuggacaggggucgcucagaauggaaccuccagcgccugcaagagacggucuauuaaauccuuuuucagccgccucaacuggcugcaucaacuuaaguauaaguacccugcgcugaaugugacaaugcccaacaaugagaaauuugacaagcucuauaucuggggcguucaccacccuucuaccgauuccgaccagauuagccuguacgcccaggcuuccggcagagugacggucucuacaaaacggagccagcaaaccgugaucccgaacauugggucccgccccugggugagaggagucagcucucggaucuccauuuacuggacaaucguuaagccuggcgauauccugcucauuaacagcaccgggaaucugaucgcuccccgcggauauuucaaaauuagaaacggcaagucuagcaucaugcgguccaaugccccuauugggaaguguaacucugaaugcaucacccccaauggaagcaucccgaacgacaaaccuuuucagaaugugaaccgcauuacauacggcgccugucccagauaugugaagcagaauacgcuuaaacuggcgaccggcaugcggaacgucccugagaagcagacacgcgggaucuucggagccauugcuggcuuuaucgaaaaugggugggagggaaugguggacggcugguacggguucagacaucaaaacuccgagggaaccggccaggccgcugaucucaaaagcacacaggccgccauuaaucaaaucaacggcaagcugaaucggcuuaucgagaaaaccaacgaaaaguuucaccagauugaaaaggaguucucugaaguugaggggagaauccaggaccuggagaaauauguggaagauacgaagauugaccucugguccuacaacgcugagcugcuggucgcgcucgaaaaucagcauacaaucgaucugaccgacagcgagaugaacaaacuuuucgaacgcacccggaagcaacugagagagaaugccgaggauaugggaaacggcugcuuuaaaauuuaucacaagugugacaaugcuugcaucgggucuauucgcaacggaacauacgaucacgacguguaccgggaugaagcccucaauaacagauuccagaucaagggcguugagcugaaauccggguauaaggacuggauccuuuggauuagcuuugccaucuccugcuuccugcucugugugguccugcugggcuuuauuaugugggcuugccagaaaggaaauauccgcuguaacauuugcaucuga

SEQ ID NO: 184843 - RNA, 1701 nt, Artificial Sequence; identical to SEQ ID NO: 183096
  derived and/or modified sequence opt5 from hemagglutinin__InfluenzaA__ABU92670

SEQ ID NO: 184844 - RNA, 1701 nt, Artificial Sequence
  derived and/or modified sequence opt5 from hemagglutinin__InfluenzaA__ABU92671
augaagaccaucauugcccugagccacauccucugccugguguucgcucagaaacuucccgucaacgacaauuccacagccacgcugugucucggccaucacgcgguuccuaacgggacccuggugaagacaauuaccaaugaucauaucgaggugacaaacgcuaccgaacuuguccaaucuagcuccacaggaagaauuugcgacaucccgcaccagauccuggauggcgagaauuguacccucauugacgcccugcugggggauccccauugcgacggauuucagaacaaagaaugggaucucuucguggagcggucuacggccuacagcaauuguuauccuuacgacguucccgauuaugcuucccugcgcucucuuguggccagcuccggcacccuggaauuuaacaaugagagcuucaacuggacaggggucgcucagaauggaaccucuuccgccugcaagagacggagcaucaaauccuuuuucucucgccucaacuggcugcaccaacuuaaguacaaguauccugcgcugaaugugacaaugcccaacaaugagaaauuugacaagcucuacauuuggggcguucaccauccuagcaccgauucugaccagaucucccuguaugcccaggcuccgggcagagugacggucagcacaaaacggucccagcaaaccgugauucccaacaucgggucucgcccuugggugagaggagucagcucccggauuagcaucuacuggacaaucguuaagcccggcgauauucugcucaucaacucuaccgggaaucugauugccccucgcggauacuucaaaaucagauccggcaagagcucuauuaugcggagcaacgcucccaucgggaaguguaauuccgaaugcaucaccccgaacggaucuauuccuaaugacaaacccuuucagaacgugaaucgcaucacauauggcgccuguccuagauacgugaagcagaacacgcuuaaacuggcgaccggcaugcggaauguccccgagaagcagacacgcgggauuuucggagccaucgcuggcuuuauugaaaacgggugggagggaaugguggacggcugguauggguucagacaccaaaauagcgagggaaccggccaggccgcugaucucaaauccacacaggccgccaucaaccaaaucaauggcaagcugaaccggcuuauugagaaaaccaaugaaaaguuucaucagaucgaaaaggaguucagcgaagcugaggggcgcauucaggaccuggagaaauacguugaagauacgaagaucgaccucuggucuuauaacgcggagcugcugguggcccucgaaaaccagcacacaauugaucugaccgacuccgagaugaauaaacuuuucgaaagaacccggaagcaacugagagagaacgcugaggauaugggaaauggcugcuuuaaaaucuaccacaagugugacaacgccugcauugggagcauccgcaauggaacauaugaucaugacgucuaccgggaugaagcccucaacaauagauuccagaucaagggcguggagcugaaaucuggguacaaggacuggauucuuuggaucuccuuugcuauuagcugcuuccugcucuguguugugcugcugggcuuuaucaugugggccugccagaaaggaaacauucgcuguaauaucugcaucuga

SEQ ID NO: 184845 - RNA, 1701 nt, Artificial Sequence; identical to SEQ ID NO: 183096
  derived and/or modified sequence opt5 from hemagglutinin__InfluenzaA__ABU92672

SEQ ID NO: 184846 - RNA, 1701 nt, Artificial Sequence; identical to SEQ ID NO: 183096
  derived and/or modified sequence opt5 from hemagglutinin__InfluenzaA__ABU92673

SEQ ID NO: 184847 - RNA, 1701 nt, Artificial Sequence
  derived and/or modified sequence opt5 from hemagglutinin__InfluenzaA__ABU92674
augaagaccaucauugcccugagcuacauccucugccugguguucgcucagaaacuucccgucaacgacaauuccacagccacgcugugucucggccaccaugcgguuccuaacgggacccuggugaagacaauuaccaaugaucacaucgaggugacaaacgcuaccgaacuuguccaaucuagcuccacaggaagaauuugcgacucuccgcaucagauccuggauggcgagaauuguacccucaucgacgcccugcugggggauccccacugcgacggauuucagaacaaagaaugggaucucuucguggagcggcgcacggccuauagcaauuguuacccuuaugacguucccgauuacgcuucccugagaucucuuguggccagcuccggcacccuggaauuuaacaaugagagcuucaacuggacaggggucgcucagaauggaaccucuuccgccugcaagcggcgcagcauuaaauccuuuuucucuagacucaacuggcugcaucaacuuaaguauaaguacccugcgcugaaugugacaaugcccaacaaugagaaauuugacaagcucuauaucuggggcguucaccacccuagcaccgauucugaccagauuucccuguacgcccaggcuagcggccgggugacggucuccacaaaacgcucucagcaaaccgugaucccgaacauugggagcagacccugggugcggggagucuccagccgcaucucuauuuacuggacaaucguuaagccuggcgauauccugcucauuaacuccaccgggaaucugaucgcccccagaggauauuucaaaauucggagcggcaagucuagcaucaugcgcuccaacgcuccuauugggaaguguaauucugaaugcaucacccccaacggaagcaucccgaaugacaaaccuuuucagaacgugaauagaauuacauacggcgccuguccccgguaugugaagcagaacacgcuuaaacuggcgaccggcaugcgcaaugucccugagaagcagacaagagggaucuucggagccauugcuggcuuuaucgaaaacgggugggagggaaugguggacggcugguacggguuccggcaucaaaauuccgagggaaccggccaggccgcugaucucaaaagcacacaggccgccauuaaccaaaucaauggcaagcugaacagacuuaucgagaaaaccaaugaaaaguuucaccagauugaaaaggaguucucugaaguugaggggcgcauccaggaccuggagaaauauguggaagauacgaagauugaccucugguccuacaacgcugagcugcuggucgcgcucgaaaaccagcauacaaucgaucugaccgacagcgagaugaauaaacuuuucgaacggaccagaaagcaacugcgcgagaacgccgaggauaugggaaauggcugcuuuaaaauuuaucacaagugugacaacgcuugcaucgggucuauucggaauggaacauacgaucacgacguguacagagaugaagcccucaacaaucgcuuccagaucaagggcguugagcugaaauccggguauaaggacuggauccuuuggauuagcuuugccaucuccugcuuccugcucugugugguccugcugggcuuuauuaugugggcuugccagaaaggaaacauccgguguaauauuugcaucuga

SEQ ID NO: 184848 - RNA, 1701 nt, Artificial Sequence
  derived and/or modified sequence opt5 from hemagglutinin__InfluenzaA__ABU92675
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacggauaacgaccagaucucccucuaugcgcaggccagcggccgcauuacaguguccaccaaaagaucucaacagacaguuaucccgaauauugggagccggccccgcgugagagauaucccuucccggaucagcauuuacuggaccaucgucaagcccggagacauucugcugaucaacucuaccggcaaucucauugcuccucgcggguacuuuaaaaucagauccggaaagagcucuaucaugcggagcgacgcccccauuggcaaguguaacuccgaaugcaucacaccgaauggcucuauuccuaacgauaaacccuuccagaaugugaaccgcaucacguauggggcuuguccuagauacgugaagcagaauacccugaaacuugccacaggaaugcggaacguccccgagaagcaaacccgcggcauuuuuggggcgaucgccggauucaucgaaaauggcugggaggggaugguugacggaugguauggcuuuagacaccagaacagcgagggcauugggcaggcugccgaucugaaauccacacaagcugccaucgaccagauuaauggaaagcucaaccggcugaucggcaaaaccaaugaaaaguuccaccagauugagaaggaguucagcgaaguggaagggagaauccaggaucuugagaaauacguggaggacacgaagauugaucuguggucuuauaacgccgaacuccuggucgcucuggagaaccaacauacaaucgaccucaccgauuccgaaaugaauaaacuguuugagcgcaccaagaaacagcuucgggaaaacgcggaggacaugggaaauggcugcuucaagaucuaccacaagugugauaacgccugcauggggagcauuagaaauggcacauaugaccaugacguguaccgcgaugaggcucugaacaaucgguuucagaucaaaggaguugaacucaagucuggcuacaaagacuggauucuguggaucuccuucgccauuagcugcuuucuucuguguguggcccuccugggguucaucaugugggcuugccagaagggaaacaucagauguaauauuugcaucuga

SEQ ID NO: 184849 - RNA, 1701 nt, Artificial Sequence; identical to SEQ ID NO: 183657
  derived and/or modified sequence opt5 from hemagglutinin__InfluenzaA__ABU92676

SEQ ID NO: 184850 - RNA, 1701 nt, Artificial Sequence; identical to SEQ ID NO: 184777
  derived and/or modified sequence opt5 from hemagglutinin__InfluenzaA__ABU92677

SEQ ID NO: 184851 - RNA, 1701 nt, Artificial Sequence
  derived and/or modified sequence opt5 from hemagglutinin__InfluenzaA__ABU92678
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgggcugcaaaacaaaaagugggaucucuuugucgaaagaagcaaagccuauuccaauuguuacccuuaugacgugcccgauuacgcuucucugcggagccuuaucgccuccagcggaacgcuggaguucaacaaugaaucuuuuaacuggaccggcguuacacagaauggcaccuccagcgcuugcaagcgcagaucuaacaauuccuucuuuagccggcucaacuggcugacacaucuuaaguucaaauauccugcccugaaugugaccaugcccaacaacgaggaguuugacaagcucuacauuuggggaguccaccauccugggacggauaaugaccagaucucucuguaugcgcaggccuccggccgcauuacagugagcaccaaaagaucccaacagacaguuaucccgaacauugggucucggccccgcgugagagauaucccuagccggaucuccauuuacuggaccaucgucaagcccggagacauucugcucaucaauagcaccggcaaccugauugcuccucgcggguacuucaaaaucagaucuggaaaguccagcaucaugcggucugacgcccccauuggcaauuguaacagcgaaugcaucacaccgaauggcuccauuccuaacgauaagcccuuucagaaugugaaccgcaucacguauggggcuuguccuagauacgugaaacagaauacccuuaagcuggccacaggaaugcggaacguccccgagaaacaaacccgcggcauuuucggggcgaucgccggauuuaucgaaaauggcugggaggggaugguugacggaugguauggcuucagacaccagaacucugagggcauugggcaggcugccgaucucaagagcacacaagcugccaucgaccagauuaauggaaaacugaaccggcuuaucggcaagaccaacgaaaaauuucaccagauugagaaggaguucuccgaaguggaagggagaauccaggaucuggagaaguacguggaggacacgaaaauugaucucuggagcuauaaugccgaacugcuggucgcucucgagaaccaacauacaaucgaccugaccgauucugaaaugaauaaacuuuucgagcgcaccaagaagcagcugcgggaaaacgcggaggacaugggaaauggcugcuuuaaaaucuaccacaagugugauaacgccugcauuggguccaucagaaauggcacauaugaccaugacguguaccgcgaugaggcucucaacaaucgguuccagauuaagggaguugaacugaaaagcggcuacaaggacuggauccuuuggauuucuuuugccaucuccugcuuccugcucuguguggcccugcugggguuuaucaugugggcuugccagaaaggaaacauuagauguaauaucugcauuuga

SEQ ID NO: 184852 - RNA, 1701 nt, Artificial Sequence
  derived and/or modified sequence opt5 from hemagglutinin__InfluenzaA__ABU92680
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaaacaaacccgcggcaucuucggggcgauugccggauuuaucgagaauggcugggaagggaugguggauggaugguauggcuucagacaccagaacuccgagggcaucgggcaggcugccgaccugaagucuacacaagcugccauugaucagaucaauggaaaacucaaccggcugauuggcaagaccaacgagaaguuccaccagaucgaaaaagaguuuagcgaaguggaggggcgcauucaggaccuugaaaaguacgucgaggauacgaaaaucgaccugugguccuauaaugccgagcuccugguggcucuggaaaaccaacauacaauugaucucaccgacagcgagaugaauaagcuguucgaaaagaccaagaagcagcuuagagagaacgcggaagauaugggaaauggcugcuuuaaaaucuaccacaagugugacaacgccugcaucgggucuauucggaauggcacauaugaucaugacguuuacagagacgaggcucugaacaaucgcuuccagaucaaaggaguggagcucaaguccggcuacaaagauuggauucuguggaucagcuuugccauuucuugcuuccuucugugugucgcccuccugggguuuaucaugugggcuugccagaagggaaacauccgguguaauauuugcaucuga

SEQ ID NO: 184853 - RNA, 1701 nt, Artificial Sequence; identical to SEQ ID NO: 184781
  derived and/or modified sequence opt5 from hemagglutinin__InfluenzaA__ABU92681

SEQ ID NO: 184854 - RNA, 1701 nt, Artificial Sequence; identical to SEQ ID NO: 183097
  derived and/or modified sequence opt5 from hemagglutinin__InfluenzaA__ABU92682

SEQ ID NO: 184855 - RNA, 1701 nt, Artificial Sequence; identical to SEQ ID NO: 184786
  derived and/or modified sequence opt5 from hemagglutinin__InfluenzaA__ABU92683

SEQ ID NO: 184856 - RNA, 1701 nt, Artificial Sequence
  derived and/or modified sequence opt5 from hemagglutinin__InfluenzaA__ABU92684
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucauugaaagaucuaaagccuauagcaauuguuacccuuaugacguccccgauuacgcuucccuccggucucugguggccagcuccggaacgcuugaguuuaacaaugaaucuuucgacuggaccggcguuacacagaacggcaccucuuccgcuugcaagcgcagaagcaauaagagcuuuuucucccggcugaacuggcucacacaucugaaauauaaguacccugcccuuaaugugaccaugcccaacaaugagaaauuugauaagcuguauaucuggggaguccaccauccugggacggacagcgaucagauuucucucuacgcgcaggccccgggccgcaucacaguguccaccaaaagaagccaacagacaguuauucccaacaucgggucccggccucgcgugagagacgucucuagccggaucuccauuuacuggaccaucgugaagcccggagacauucugcugaucaacagcaccggcaaucucauugcuccucgcggguauuucaagaucagaucuggaaaauccagcaucaugcggucugaugcccccauuggcaaguguaacagcgagugcaucacaccgaauggcuccauuccuaacgacaaacccuuucagaaugugaaccgcaucacguacggggcuuguccuagauaugucaagcagaauacccugaaacuugccacaggaaugcggaacguucccgaaaagcaaacccgcggcauuuucggggcgaucgccggauuuaucgagaauggcugggaagggaugguggauggaugguacggcuucagacaccagaacucugagggcacagggcaggcugccgaccugaaaagcacccaagcugccauuaaucagaucaacggaaagcucaaucggcugauuggcaagacgaacgagaaauuucaccagaucgaaaaggaguucuccgaaguggaggggcgcauucaggaucuugaaaaauaugucgaggacacaaagaucgaucuguggagcuacaaugccgagcuccugguggcucuggaaaaccaacauaccauugaccucaccgauucugagaugaacaaacuguucgaaagaacaaagaagcagcuucgggagaaugcggaagacaugggaaacggcugcuuuaaaaucuaucacaagugugauaaugccugcaucggguccauuagaaacggcaccuacgaccaugacguuuaccgcgaugaggcucugaauaaccgguuccagaucaaaggaguggagcucaagagcggcuauaaagacuggauucuguggaucucuuuugccauuuccugcuuccuucugugugucgcccuccugggguuuaucaugugggcuugccagaagggaaauaucagauguaacauuugcaucuga

SEQ ID NO: 184857 - RNA, 1701 nt, Artificial Sequence
  derived and/or modified sequence opt5 from hemagglutinin__InfluenzaA__ABU92685
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguauuucaagauuagauccggaaaaagcucuaucaugaaaagcgaugccccuaucggcaaguguaacuccgagugcauuacacccaauggcucuaucccgaacgacaagccuuuucagaaugucaaccggauuacguacggggcuuguccccgcuauguuaaacagaauacccugaaacuugccacaggaaugagaaacgugccugaaaagcaaacccggggcaucuucggggcgauugccggauuuaucgagaauggcugggaagggaugguggauggaugguacggcuuccgccaccagaacagcgagggcacagggcaggcugccgaccugaaguccacccaagcugccaucaaucagauuaacggaaagcucaauagacugaucggcaaaacgaacgagaaguuucaccagauugaaaaagaguucagcgaagucgaggggcggauccaggaucuugaaaaguauguggaggacacaaaaauugaucuguggucuuacaaugccgagcuccugguugcucuggaaaaccaacauaccaucgaccucaccgauuccgagaugaacaagcuguucgaaagaacaaagaaacagcuucgcgagaaugcggaagacaugggaaacggcugcuuuaagauuuaucacaaaugugauaaugccugcaucgggagcauccggaacggcaccuacgaccaugacguguacagagaugaggcucugaauaaccgcuuccagauuaagggagucgagcucaaaucuggcuauaaggacuggauccuguggauuuccuuugccaucagcugcuuccuucuguguguggcccuccugggguuuauuaugugggcuugccagaagggaaauauccgguguaacaucugcauuuga

SEQ ID NO: 184858 - RNA, 1701 nt, Artificial Sequence; identical to SEQ ID NO: 184786
  derived and/or modified sequence opt5 from hemagglutinin__InfluenzaA__ABU92686

SEQ ID NO: 184859 - RNA, 1701 nt, Artificial Sequence; identical to SEQ ID NO: 184786
  derived and/or modified sequence opt5 from hemagglutinin__InfluenzaA__ABU92687

SEQ ID NO: 184860 - RNA, 1701 nt, Artificial Sequence; identical to SEQ ID NO: 184819
  derived and/or modified sequence opt5 from hemagglutinin__InfluenzaA__ABU92688

SEQ ID NO: 184861 - RNA, 1701 nt, Artificial Sequence; identical to SEQ ID NO: 184786
  derived and/or modified sequence opt5 from hemagglutinin__InfluenzaA__ABU92689

SEQ ID NO: 184862 - RNA, 1701 nt, Artificial Sequence
  derived and/or modified sequence opt5 from hemagglutinin__InfluenzaA__ABU92691
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaucugaaauauaaguacccugcccuuaaugucaccaugcccaacaaugagaaauuugauaagcuguauauuuggggagugcaccauccugggacggacagcgaucagaucucucucuacgcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguauuucaagauuagauccggaaaaagcucugucaugcggagcgaugccccuaucggcaaguguaacuccgagugcaucacacccaauggcucuauuccgaacgacaaaccuuuucagaauguuaaccgcaucacguacggggcuugucccagauaugugaagcagaauacccugaaacuugccacaggaaugcggaacgugccugaaaagcaaacccgcggcauuuucggggcgaucgccggauuuauugagaauggcugggaagggauggucgauggaugguacggcuucagacaccagaacagcgagggcacagggcaggcugccgaccugaaauccacccaagcugccaucaaucagaucaacggaaagcucaaucggcugauuggcaagacgaacgagaaauuucaccagaucgaaaaggaguucagcgaaguggaggggcgcauucaggaucuugaaaaauauguugaggacacaaagaucgaucuguggucuuacaaugccgagcuccugguggcucuggaaaaccaacauaccauugaccucaccgauuccgagaugaacaaacuguucgaaagaacaaagaagcagcuucgggagaaugcggaagacaucggaaacggcugcuuuaaaauuuaucacaagugugauaaugccugcaucgggagcaucagaaacggcaccuacgaccauaaugucuaccgcgacgaggcucugaacaaucgguuccagauuaaaggaguggagcucaagucuggcuauaaagauuggauccuguggauuuccuuugccaucagcugcuuccuucuguguguugcccuccugggguuuauuaugugggcuugccagaagggaaacaucagauguaauaucugcauuuga

SEQ ID NO: 184863 - RNA, 1701 nt, Artificial Sequence; identical to SEQ ID NO: 183714
  derived and/or modified sequence opt5 from hemagglutinin__InfluenzaA__ABU92692

SEQ ID NO: 184864 - RNA, 1701 nt, Artificial Sequence
  derived and/or modified sequence opt5 from hemagglutinin__InfluenzaA__ABU92693
augaaggccaucauugcucugagcuacauccucugccugguguucgcccagaaacuucccggcaacgacaauuccaccgcgacacugugucucgggcaccaugcugucccuaacggaacgauuguuaagaccaucacaaaugaucaaauugaggugaccaacgccacagaacuggugcagaucucuagcaccggcgagaucugcgacuccccgcaccagauucuugauggggaaaauuguacacugaucgacgcccuccugggagauccccagugcgacggcuuucaaaacaaaaagugggaucuguucgucgagagaucuaaagccuauagcaauuguuacccuuaugacgugcccgauuacgccucccuccggucucugguugcuagcuccgggacccuugaauuuaacaaugagagcuucgacuggacgggagugacccagaacggcacaucuuccgccugcaagcgcagaagcgauaagucuuucuucucccggcugaauuggcucacccaucugaaauauaaguacccugcgcuuaacgucacaaugcccaauaacgagaaauuugacaagcuguauauuuggggcgugcaccauccugggaccgauagcgaccagaucucucucuacgcccaggcuuccggacgcauuacgguuagcacaaaaagaucccaacagaccgugaucccgaauauuggcucucggccccgcgucagagacgugagcucccggaucagcaucuacuggacaauugugaagccuggggauauccugcugauuaacucuaccggaaaccucaucgcuccccgcggcuauuucaagauuagauccgggaaaagcucuaucaugcggagcgacgcuccuaucggaaaguguaauuccgaaugcauuacccccaacggcucuaucccgaaugauaaaccuuuucagaacgucaaucgcauuacauacggcgccugucccagauauguuaagcagaacacgcugaaacuugcgaccgggaugcggaaugugccugagaagcaaacacgcggaaucuucggcgccauugcuggguuuaucgaaaacggaugggagggcaugguggacgggugguacggauucagacaccagaauagcgagggcaccggccaggccgcugaucugaaauccacacaagccgccaucaaccagauuaaugggaagcucaaccggcugaucggaaagaccaaugaaaaauuucaccagauugagaaggaauuuagcgaggucgaaggcagaauccaggaccuugagaaauauguggaggauacgaagauugaccuguggucuuacaacgcugaacuccugguugcgcuggagaaucaacauacaaucgaucucaccgacuccgaaaugaacaaacuguucgagcgcaccaagaagcagcuucgggaaaacgccgaggauauggggaauggaugcuuuaaaauuuaucacaagugugacaacgcuugcaucggcagcaucagaaaugggacauacgaccaugauguguaccgcgacgaggcccugaacaaucgguuccagauuaaaggcgucgaacucaagucuggauauaaagauuggauccuguggauuuccuuugccaucagcugcuuccuucuguguguggcucuccugggcuuuauuaugugggccugccagaaggggaacaucagauguaauaucugcauuuga

SEQ ID NO: 184865 - RNA, 1701 nt, Artificial Sequence
  derived and/or modified sequence opt5 from hemagglutinin__InfluenzaA__ABU92694
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaaaacaaacccgcggcaucuuuggggcgauugccggauucaucgagaacggcugggaagggaugguggacggaugguauggcuuuagacaccaaaauucugagggcaucgggcaggcugccgaucuuaagagcacacaggcugccauuaaccagaucaauggaaaacucaaccggcugauuggcaagaccaacgagaaguuccaccagaucgaaaaagaguucuccgaaguggaggggcgcauucaggaccuugaaaaguacgucgaggauacgaaaguggaccuguggagcuauaaugccgagcuccugguugcucuggaaaaccaacauacaaucgaucucaccgacucugagaugaauaagcuguuugaaagaaccaaaaagcagcuucgggagaacgcggaagauaugggaaauggcugcuucaagauuuaccacaaaugugacaacgccugcaucggguccaucagaaauggcacauaugaucaugacguguaccgcgacgaggcucugaacaaucgguuucagauuaagggagucgagcucaaaagcggcuacaaggauuggauccuguggauuucuuucgccaucuccugcuuucuucuguguguggcccuccugggguucauuaugugggcuugccagaaaggaaacaucagauguaauaucugcauuuga

SEQ ID NO: 184866 - RNA, 1701 nt, Artificial Sequence; identical to SEQ ID NO: 184777
  derived and/or modified sequence opt5 from hemagglutinin__InfluenzaA__ABU92695

SEQ ID NO: 184867 - RNA, 1701 nt, Artificial Sequence
  derived and/or modified sequence opt5 from hemagglutinin__InfluenzaA__ABU92696
augaagaccaucauugcccugggcuacauccucugccugguguucgcucagaaacuucccgggaacgacaauagcacagccacgcugugucucggacaccaugcggucccuaacggcaccauuguuaagacaaucaccaaugaucaaauugaggugacaaacgcuaccgaacuggugcaguccucuagcacagggggaaucugcgacuccccgcaccagauccuugauggcgagaauuguacccugauugacgcccuccugggggauccccagugcgacggauuucaaaacaaaaagugggaucuguucgucgaaagaucuaaagccuauagcaauuguuacccuuaugacgugcccgauuacgcuucccuccggucucugaucgccagcuccggcacgcuugaguuuaacaaugagagcuucaacuggaccggcguuacacagaaugggaccucuuccgcuugcaagcgcagaagcaacucuuccuuuuucagccggcugaauuggcucacacaucugaaguuuaaauauccugcccuuaacgugaccaugcccaauaacgaagaguucgacaagcuguacauuuggggaguccaccauccuggcacggauaacgaccagaucucucucuaugcgcaggccuccgggcgcauuacagugagcaccaaaagaucccaacagacaguuaucccgaauauuggaucucggccccgcgugagagauaucccuagccggaucuccauuuacuggaccaucgucaagcccggcgacauucugcugaucaacagcaccgggaaucucauugcuccucgcggauacuuuaaaaucagaucuggcaaguccagcaucaugcggucugacgcccccauuggcaaguguaacagcgaaugcaucacaccgaauggguccauuccuaacgauaaacccuuccagaaugugaaccgcaucacguauggagcuuguccuagauacgugaagcagaauacccugaaacuugccacaggcaugcggaacguccccgagaagcaaacccgcgggauuuuuggagcgaucgccggcuucaucgaaaaugggugggagggaaugguugacggcugguauggcuuuagacaccagaacucugaggggauuggacaggcugccgaucugaaaagcacacaagcugccaucgaccagauuaauggcaagcucaaccggcugaucgggaaaaccaaugaaaaguuccaccagauugagaaggaguucuccgaaguggaaggaagaauccaggaucuugagaaauacguggaggacacgaagauugaucuguggagcuauaacgccgaacuccuggucgcucuggagaaccaacauacaaucgaccucaccgauucugaaaugaauaaacuguuugagcgcaccaagaaacagcuucgggaaaacgcggaggacaugggcaaugggugcuucaagaucuaccacaagugugauaacgccugcauuggcuccaucagaaauggaacauaugaccaugacguguaccgcgaugaggcucugaacaaucgguuucagauuaaaggcguugaacucaagagcggguacaaagacuggauccuguggauuucuuucgccaucuccugcuuucuucuguguguggcccuccugggauucaucaugugggcuugccagaagggcaacauuagauguaauaucugcauuuga

SEQ ID NO: 184868 - RNA, 1701 nt, Artificial Sequence; identical to SEQ ID NO: 183657
  derived and/or modified sequence opt5 from hemagglutinin__InfluenzaA__ABU92697

SEQ ID NO: 184869 - RNA, 1701 nt, Artificial Sequence; identical to SEQ ID NO: 183267
  derived and/or modified sequence opt5 from hemagglutinin__InfluenzaA__ABU92698

SEQ ID NO: 184870 - RNA, 1701 nt, Artificial Sequence
  derived and/or modified sequence opt5 from hemagglutinin__InfluenzaA__ABU92699
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacugggcuggcgugacccagaauggcacauccagcgccugcaagcgcagaucuaacaauuccuuuuucagccggcugaacuggcucacccaucugaaguuuaaauauccugcgcuuaaugucacaaugcccaacaacgagaaguucgacaaacuguacaucuggggagugcaccauccugggaccgauaaugaccagauuuuucucuaugcccaggcuucuggccgcaucacgguuuccacaaagagaagccaacagaccgugauuccgaacaucgggucccggccccgcgucagaaauauuccuucucggaucagcaucuacuggacaauugugaaacccggagauauccugcugauuaacuccaccggcaaucucaucgccccucgcggguacuucaagauuagaagcggaaagucuuccaucaugcggagcgacgcucccaucggcaaauguaacucugagugcauuaccccgaauggcagcaucccuaacgacaagcccuuucagaaugugaaccgcauuacauauggggccuguccuagauacgucaaacagaauacgcugaaacuugcgaccggaaugcggaacguucccgaaaaacaaacacgcggcaucuucggggccauugcuggauuuaucgagaauggcugggaagggaugguggauggaugguauggcuucagacaccagaacuccgagggcaucgggcaggccgcugaccugaagucuacccaagccgccauugaucagaucaauggaaaacucaaccggcugauuggcaagacaaacgagaaguuccaccagaucgaaaaagaguuuagcgaaguggaggggcgcauucaggaccuugaaaaguacgucgaggauaccaaaaucgaccugugguccuauaaugcugagcuccugguggcgcuggaaaaccaacauacgauugaucucacagacagcgagaugaauaagcuguucgaaaagaccaagaagcagcuuagagagaacgccgaagauaugggaaauggcugcuuuaaaaucuaccacaagugugacaacgcuugcaucgggucuauucggaauggcaccuaugaucaugacguuuacagagacgaggcccugaacaaucgcuuccagaucaaaggaguggagcucaaguccggcuacaaagauuggauucuguggaucagcuuugccauuucuugcuuccuucugugugucgcucuccugggguuuaucaugugggccugccagaagggaaacauccgguguaauauuugcaucuga

SEQ ID NO: 184871 - RNA, 1701 nt, Artificial Sequence
  derived and/or modified sequence opt5 from hemagglutinin__InfluenzaA__ABU92700
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggaggcaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagcgcuucgacaagcuguacaucuggggcgugcaccauccugggacggauaaugaccagauuuuucucuaugcgcaggccucuggaagaaucacaguuuccaccaaacggagccaacagacagugauuccgaacaucggcucccgccccagaguccggaauauuccuucucgcaucagcaucuacuggaccauugugaagcccggggauauccugcugauuaacuccaccggaaaucucaucgcuccuagaggcuacuucaaaauucggagcgggaagucuuccaucaugcgcagcgacgcccccaucggaaaguguaacucugaaugcauuacaccgaauggcagcaucccuaacgacaaacccuuucagaaugugaacagaauuacguauggcgcuuguccucgguacgucaagcagaauacccugaaacuugccacagggaugcgcaacguucccgagaagcaaaccagaggaaucuucggcgcgauugccggguuuaucgaaaauggaugggagggcaugguggaugggugguauggauuccggcaccagaacuccgagggcaucggccaggcugccgaccugaaaucuacacaagcugccauugaucagaucaaugggaagcucaacagacugauuggaaaaaccaacgaaaaguuccaccagaucgagaaggaauuuagcgagguggaaggccgcauucaggaccuugagaaauacgucgaggauacgaagaucgaccugugguccuauaaugccgaacuccugguggcucuggagaaccaacauacaauugaucucaccgacagcgaaaugaauaaacuguucgagaagaccaaaaagcagcuucgggaaaacgcggaggauauggggaauggaugcuuuaagaucuaccacaaaugugacaacgccugcaucggcucuauuagaaaugggacauaugaucaugacguuuaccgcgacgaggcucugaacaaucgguuccagaucaagggcguggaacucaaauccggauacaaggauuggauucuguggaucagcuuugccauuucuugcuuccuucugugugucgcccuccugggcuuuaucaugugggcuugccagaaagggaacaucagauguaauauuugcaucuga

SEQ ID NO: 184872 - RNA, 1701 nt, Artificial Sequence
  derived and/or modified sequence opt5 from hemagglutinin__InfluenzaA__ABU92701
augaagaccaucauugcccugagcuacauccucugccugguguucgcucagaaacuucccgagaacgacaauuccacagccacgcugugucucggccaccaugcggucccuaacgggaccauuguuaagacaaucaccaaugaucaaauugaagugacaaacgcuaccgagcuggugcagucuagcuccacaggaggcaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagcgcuucgacaagcuguacaucuggggcgugcaccauccugggacggauaaugaccagauuuuucucuaugcgcaggccucuggaagaaucacaguuuccaccaaacggagccaacagacagugauuccgaacaucggcucccgccccagaguccggaauauuccuucucgcaucagcaucuacuggaccauugugaagcccggggauauccugcugauuaacuccaccggaaaucucaucgcuccuagaggcuacuucaaaauucggagcgggaagucuuccaucaugcgcagcgacgcccccaucggaaaguguaacucugaaugcauuacaccgaauggcagcaucccuaacgacaaacccuuucagaaugugaacagaauuacguauggcgcuuguccucgguacgucaagcagaauacccugaaacuugccacagggaugcgcaacguucccgagaagcaaaccagaggaaucuucggcgcgauugccggguuuaucgaaaauggaugggagggcaugguggaugggugguauggauuccggcaccagaacuccgagggcaucggccaggcugccgaccugaaaucuacacaagcugccauugaucagaucaaugggaagcucaacagacugauuggaaaaaccaacgaaaaguuccaccagaucgagaaggaauuuagcgagguggaaggccgcauucaggaccuugagaaauacgucgaggauacgaagaucgaccugugguccuauaaugccgaacuccugguggcucuggagaaccaacauacaauugaucucaccgacagcgaaaugaauaaacuguucgagaagaccaaaaagcagcuucgggaaaacgcggaggauauggggaauggaugcuuuaagaucuaccacaaaugugacaacgccugcaucggcucuauuagaaaugggacauaugaucaugacguuuaccgcgacgaggcucugaacaaucggcuccagaucaagggcguggaacugaaauccggauacaaggauuggauucuuuggaucagcuucgccauuucuugcuuucugcucugugucgcccugcugggcuucaucaugugggcuugccagaaagggaacaucagauguaauauuugcaucuga

SEQ ID NO: 184873 - RNA, 1701 nt, Artificial Sequence; identical to SEQ ID NO: 183636
  derived and/or modified sequence opt5 from hemagglutinin__InfluenzaA__ABU92702

SEQ ID NO: 184874 - RNA, 1701 nt, Artificial Sequence; identical to SEQ ID NO: 184852
  derived and/or modified sequence opt5 from hemagglutinin__InfluenzaA__ABU92703

SEQ ID NO: 184875 - RNA, 1701 nt, Artificial Sequence
  derived and/or modified sequence opt5 from hemagglutinin__InfluenzaA__ABU92704
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaaauaaagccuauagcaacuguuacccuuaugacgugcccgauuacgcuucccuccggucucugguugccagcuccggaacgcuugaguuuaauaacgaaucuuucaauuggaccggcgugacacagaacggcaccucuuccgcuugcaagcgcagaagcaauaacagcuuuuucucccggcugaauuggcucacacaucugaaguuuaaauauccugcccuuaacgucaccaugcccaacaaugagaaguucgacaaacuguacaucuggggagugcaccauccugggacggauaacgaccagauuuuucucuaugcgcaggccagcggccgcaucacaguuucuaccaagagaucccaacagacagugauuccgaauaucgggagccggccccgcgucagaaacauuccuucccggaucucuaucuacuggaccauugugaaacccggagauauccugcugauuaauagcaccggcaaccucaucgcuccucgcggguacuucaagauuagauccggaaagagcucuaucaugcgguccgacgcccccaucggcaaauguaauagcgagugcauuacaccgaacggcucuaucccuaaugacaagcccuuucagaacgugaaucgcauuacguauggggcuuguccuagauacgucaaacagaacacccugaaacuugccacaggaaugcggaauguucccgaaaaacaaacccgcggcaucuucggggcgauugccggauuuaucgagaacggcugggaagggaugguggauggaugguauggcuucagacaccagaauagcgagggcaucgggcaggcugccgaccugaaguccacacaagcugccauugaucagaucaacggaaaacucaaccggcugauuggcaagaccaaugagaaguuccaccagaucgaaaaagaguuuucugaaguggaggggcgcauucaggaccuugaaaaguacgucgaggauacgaaaaucgaccuguggagcuauaacgccgagcuccugguggcucuggaaaaucaacauacaauugaucucaccgacuccgagaugaacaagcuguucgaaaagaccaagaagcagcuuagagagaaugcggaagauaugggaaacggcugcuuuaaaaucuaccacaagugugacaaugccugcaucgggagcauucggaacggcacauaugaucaugacguuuacagagacgaggcucugaauaaccgcuuccagaucaaaggaguggagcucaagucuggcuacaaagauuggauucuguggaucuccuuugccauuagcugcuuccuucugugugucgcccuccugggguuuaucaugugggcuugccagaagggaaauauccgguguaacauuugcaucuga

SEQ ID NO: 184876 - RNA, 1701 nt, Artificial Sequence
  derived and/or modified sequence opt5 from hemagglutinin__InfluenzaA__ABU92705
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucucucucuaugcgcaggccccgggccgcauuacaguguccaccaaaagaagccaacagacaguuauccccaacauugggucccggccucgcgugagagauauccccucucggaucagcauuuacuggaccaucgucaagccuggagacauucugcugaucaauuccaccggcaaccucauugcuccccgcggguacuuuaaaaucagaagcggaaagucuuccaucaugcggagcgacgccccgauuggcaaguguaaaucugaaugcaucacaccuaauggcagcauucccaacgauaagccuuuccagaaugugaaccgcaucacguauggggcuugucccagauacgugaaacagaauacccugaaacuugccacaggaaugcggaacguccccgagaagcaaacccgcggcauuuuuggggcgaucgccggauucaucgaaaauggcugggaggggaugguugacggaugguauggcuuuagacaccagaacuccgagggcauugggcaggcugccgaucugaagucuacacaagcugccaucgaccagauuaauggaaaacucaaccggcugaucggcaagaccaaugaaaaguuccaccagauugagaaagaguucagcgaaguggaagggagaauccaggaucuugagaaguacguggaggacacgaaaauugaucugugguccuauaacgccgaacuccuggucgcucuggagaaccaacauacaaucgaccucaccgauagcgaaaugaauaagcuguuugagcgcaccaaaaagcagcuucgggaaaacgcggaggacaugggaaauggcugcuucaagaucuaccacaaaugugauaacgccugcauugggucuaucagaaauggcacauaugaccaugacguguaccgcgaugaggcucugaacaaucgguuuagaauuaaguccguugaacucaaaagcggauacaaggacuggauccuguggauuucuuucgccaucuccugcuuucuucuguguguggcccuccugggcuucaucaugugggcuugccagaaagggaacauucgcuguaauaucugcauuuga

SEQ ID NO: 184877 - RNA, 1701 nt, Artificial Sequence; identical to SEQ ID NO: 183097
  derived and/or modified sequence opt5 from hemagglutinin__InfluenzaA__ABU92706

SEQ ID NO: 184878 - RNA, 1701 nt, Artificial Sequence; identical to SEQ ID NO: 184786
  derived and/or modified sequence opt5 from hemagglutinin__InfluenzaA__ABU92707

SEQ ID NO: 184879 - RNA, 1701 nt, Artificial Sequence; identical to SEQ ID NO: 184786
  derived and/or modified sequence opt5 from hemagglutinin__InfluenzaA__ABU92708

SEQ ID NO: 184880 - RNA, 1701 nt, Artificial Sequence
  derived and/or modified sequence opt5 from hemagglutinin__InfluenzaA__ABU92709
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacugggcuggcgugacccagaauggcacauccagcgccugcaagcgcagaucuaacaaguccuuuuucagccggcugaauuggcucacccaucugaaauauaaguacccugcgcuuaacgucacaaugcccaauaacgagaaauuugacaagcuguauaucuggggagugcaccauccugggaccgauucugaccagauuucccucuacgcccaggcuagcggccgcaucacgguuuccacaaaaagaucucaacagaccgugauuccgaacaucgggagccggccccgcgucagagauguguccagccggauuucuaucuacuggacaaucgugaagccuggagacauucugcugaucaauuccaccggcaaccucauugcccccagaggguauuucaagaucagaagcggaaaaucuagcauuaugcgguccgacgcuccuaucggcaaguguaauucugagugcaucacccccaacggcagcauuccgaaugauaaaccuuuucagaacgucaaucgcaucacauacggggccugucccagauauguuaagcagaacacgcugaaacuugcgaccggaaugcggaaugugccugaaaagcaaacacgcggcauuuucggggccaucgcuggauuuauugagaacggcugggaagggaugguggacggaugguacggcuucagacaccaaaauuccgagggcaccgggcaggccgcugaucugaaaagcacacaggccgccaucaaccagaucaauggaaagcucaaccggcugauuggcaagaccaaugagaaauuucaccagaucgaaaaggaguucucugaagucgaggggcgcauucaggaccuugaaaaauauguggaggauacgaagaucgaccugugguccuacaacgcugagcuccugguugcgcuggaaaaccaacauacaauugaucucaccgacagcgagaugaauaaacuguucgaacgcaccaagaagcagcuucgggagaacgccgaagauaugggaaauggcugcuuuaaaaucuaucacaagugugacaacgcuugcauugagucuaucagaaaugggacauacgaucaugacguguaccgcgacgaggcccugaacaaucgguuccagaucaaaggcgucgaacucaaguccggauauaaagauuggauucuguggaucagcuuugccauuuccugcuuccuucuguguguggcucuccugggcuuuaucaugugggccugccagaaggggaacauuagauguaauaucugcaucuga

SEQ ID NO: 184881 - RNA, 1701 nt, Artificial Sequence; identical to SEQ ID NO: 183075
  derived and/or modified sequence opt5 from hemagglutinin__InfluenzaA__ABU92710

SEQ ID NO: 184882 - RNA, 1701 nt, Artificial Sequence; identical to SEQ ID NO: 183097
  derived and/or modified sequence opt5 from hemagglutinin__InfluenzaA__ABU92711

SEQ ID NO: 184883 - RNA, 1701 nt, Artificial Sequence; identical to SEQ ID NO: 183097
  derived and/or modified sequence opt5 from hemagglutinin__InfluenzaA__ABU92712

SEQ ID NO: 184884 - RNA, 1701 nt, Artificial Sequence; identical to SEQ ID NO: 184786
  derived and/or modified sequence opt5 from hemagglutinin__InfluenzaA__ABU92713

SEQ ID NO: 184885 - RNA, 1701 nt, Artificial Sequence; identical to SEQ ID NO: 184786
  derived and/or modified sequence opt5 from hemagglutinin__InfluenzaA__ABU92714

SEQ ID NO: 184886 - RNA, 1701 nt, Artificial Sequence
  derived and/or modified sequence opt5 from hemagglutinin__InfluenzaA__ABU92715
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcaauaaguccuuuuucucucggcugaacuggcucacacaucugaaauauaaguacccugcccuuaaugucaccaugcccaacaaugagaaauuugaaaagcuguauauuuggggcgugcaccauccugggacggauagcgaccagaucaaccucuacgcgcaggccucuggacgcauuacaguuuccaccaaaagaagccaacagacagugaucccgaacauuggcucccggccccgcgucagagaugugucuagccggaucuccaucuacuggaccauugugaagccuggggacauccugcugauuaauagcaccggaaaccucaucgcuccccgcggcuauuucaagauuagaucugggaaauccagcaucaugcggucugacgccccuaucggaaaguguaauagcgagugcauuacacccaacggcuccaucccgaaugauaaaccuuuucagaacgucaaucgcauuacguacggcgcuugucccagauauguuaagcagaacacccugaaacuugccacagggaugcggaaugugccugaaaagcaaacccgcggaaucuucggcgcgauugccggguuuaucgagaacggaugggagggcaugguggacgggugguacggauucagacaccaaaauucugaaggcacaggccaggcugccgaucugaaaagcacccaggcugccaucaaccagauuaaugggaagcucaaccggcugaucggaaagacgaaugagaaauuucaccagauugaaaaggaguucuccgaagucgagggcagaauccaggaccuugagaaauauguggaagauacaaagauugaccuguggagcuacaacgccgagcuccugguugcucuggaaaaccaacauaccaucgaucucaccgacucugagaugaauaaacuguucgaacgcacaaagaagcagcuucgggagaacgcggaggauauggggaauggaugcuuuaaaauuuaucacaagugugacaacgccugcaucggcuccaucagaaaugggaccuacgaucaugacguguaccgcgacgaagcucugaacaaucgguuccagauuaaaggcgucgagcucaagagcggauauaaagauuggauccuguggauuucuuuugccaucuccugcuuccuucuguguguggcccuccugggcuuuauuaugugggcuugccagaaggggaacaucagauguaauaucugcauuuga

SEQ ID NO: 184887 - RNA, 1701 nt, Artificial Sequence; identical to SEQ ID NO: 184786
  derived and/or modified sequence opt5 from hemagglutinin__InfluenzaA__ABU92716

SEQ ID NO: 184888 - RNA, 1701 nt, Artificial Sequence; identical to SEQ ID NO: 184786
  derived and/or modified sequence opt5 from hemagglutinin__InfluenzaA__ABU92717

SEQ ID NO: 184889 - RNA, 1701 nt, Artificial Sequence; identical to SEQ ID NO: 183097
  derived and/or modified sequence opt5 from hemagglutinin__InfluenzaA__ABU92718

SEQ ID NO: 184890 - RNA, 1701 nt, Artificial Sequence; identical to SEQ ID NO: 183097
  derived and/or modified sequence opt5 from hemagglutinin__InfluenzaA__ABU92719

SEQ ID NO: 184891 - RNA, 1701 nt, Artificial Sequence
  derived and/or modified sequence opt5 from hemagglutinin__InfluenzaA__ABU92720
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacuccucucuccggagccugguugcuuccagcgggacgcuugaauuuaacaaugagucuuucgacuggaccggagugacacagaacggcaccuccagcgccugcaagcgcagaucugauaaguccuuuuucagccggcugaauuggcucacacaucugaaauauaaguacccugcucuuaacgucaccaugcccaauaacgagaaauuugacaagcuguauauuuggggcgugcaccauccugggacggauucugaccagaucucccucuacgcccaggcgagcggacgcauuacaguuuccaccaaaagaucucaacagacagugaucccgaauauuggcagccggccccgcgucagagacguguccagccggaucucuaucuacuggaccauugugaagccuggggauauccugcugauuaacuccaccggaaaccucaucgcuccccgcggcuauuucaagauuagaagcgggaaaucuagcaucaugcgguccgacgccccuaucggaaaguguaauucugaaugcauuacacccaacggcagcaucccgaaugauaaaccuuuucagaacgucaaucgcauuacguacggcgccugucccagauauguuaagcagaacacccugaaacuugcuacagggaugcggaaugugccugagaagcaaacccgcggaaucuucggcgccauugcgggguuuaucgaaaacggaugggagggcaugguggacgggugguacggauucagacaccaaaauuccgagggcacaggccaggccgcugaucugaaaagcacccaggccgcuaucaaccagauuaaugggaagcucaaccggcugaucggaaagacgaaugaaaaauuucaccagauugagaaggaguucucugaagucgaaggcagaauccaggaccuugagaaauauguggaggauacaaagauugaccugugguccuacaacgccgaacuccugguugcccuggagaaucaacauaccaucgaucucaccgacagcgaaaugaacaaacuguucgagcgcacaaagaagcagcuucgggaaaacgcugaggauauggggaauggaugcuuuaaaauuuaucacaagugugacaacgcgugcaucggcucuaucagaaaugggaccuacgaccaugauguguaccgcgacgaggcccugaacaaucgguuccagauuaaaggcgucgaacucaaguccggauauaaagauuggauccuguggauuagcuuugcuaucuccugcuuccuucuguguguggcccuccugggcuuuauuaugugggccugccagaaggggaacaucagauguaauaucugcauuuga

SEQ ID NO: 184892 - RNA, 1701 nt, Artificial Sequence
  derived and/or modified sequence opt5 from hemagglutinin__InfluenzaA__ABU92721
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggccuccggacgcauuacaguuagcaccaaaagaucccaacagacagugaccccgaauaucggcucucggccccgcgucagagacgugagcucccggauuagcaucuacuggaccaucgugaagccuggggauauucugcugaucaacucuacaggaaaccucauugcuccccgcggcuauuucaagaucagauccgggaaaagcucuauuaugcggagcgacgccccuaucggaaaguguaauuccgaaugcaucacgcccaacggcucuauuccgaaugauaaaccuuuucagaacgucaaucgcaucaccuacggcgcuugucccagauauguuaagcagaacacacugaaacuugccaccgggaugcggaaugugccugagaagcaaacacgcggaauuuucggcgcgaucgccggguuuauugaaaacggaugggagggcaugguggacgggugguacggauucagacaccagaauagcgagggcaccggccaggcugccgaucugaaauccacgcaagcugccaucaaccagaucaaugggaagcucaaccggcugauuggaaagacaaaugaaaaauuucaccagaucgagaaggaauuuagcgaggucgaaggccgcauucaggaccuugagaaauauguggaggauaccaagaucgaccuguggucuuacaacgccgaacuccugguugcucuggagaaucaacauaccauugaucucacagacuccgaaaugaacaaacuguucgagagaaccaagaagcagcuucgggaaaacgcggaggauauggggaauggaugcuuuaaaaucuaucacaagugugacaacgccugcauuggcagcaucagaaaugggacauacgaccaugauguguaccgcgacgaggcucugaacaaucgguuccagaucaaaggcgucgaacucaagucuggauauaaagauuggauucuguggaucuccuuugccauuagcugcuuccuucuguguguggcccuccugggcuuuaucaugugggcuugccagaaggggaacauuagauguaauaucugcaucuga

SEQ ID NO: 184893 - RNA, 1701 nt, Artificial Sequence; identical to SEQ ID NO: 184777
  derived and/or modified sequence opt5 from hemagglutinin__InfluenzaA__ABU92722

SEQ ID NO: 184894 - RNA, 1701 nt, Artificial Sequence; identical to SEQ ID NO: 183097
  derived and/or modified sequence opt5 from hemagglutinin__InfluenzaA__ABU92723

SEQ ID NO: 184895 - RNA, 1701 nt, Artificial Sequence; identical to SEQ ID NO: 184880
  derived and/or modified sequence opt5 from hemagglutinin__InfluenzaA__ABU92724

SEQ ID NO: 184896 - RNA, 1701 nt, Artificial Sequence
  derived and/or modified sequence opt5 from hemagglutinin__InfluenzaA__ABU92725
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuaaccucuacgcgcaggccuccggccgcaucacaguuagcaccaaaagaucccaacagacagugauuccgaauaucgggucucggccccgcgucagagaugugccuagccggauuuccaucuacuggaccaucgugaagcccggagaccugcugcucauuaacagcaccggcaaucugaucgcuccucgcggguauuucaagauuagaucuggaaaauccagcaucaugcggucugacgcccccauuggcaaguguaacagcgagugcaucacaccgaauggcuccaucccuaacgauaaacccuuucagaaugucaaccgcauuacguacggggcuuguccuagauauguuaagcagaauacccuuaaacuggccacaggaaugcggaacgugcccgaaaagcaaacccgcggcaucuucggggcgauugccggauuuaucgagaauggcugggaagggaugguggacggaugguacggcuucagacaccagaacucugagggcacagggcaggcugccgaucucaaaagcacccaagcugccauuaaucagaucaacggaaagcugaaucggcuuaucggcaagacgaacgagaaauuucaccagauugaaaaggaguucuccgaagucgaggggagaauccaggaccuggaaaaauauguggaggauacaaagauugaccucuggagcuacaacgccgagcugcugguugcucucgaaaaucaacauaccaucgaucugaccgacucugagaugaacaaacuuuucgaacgcacaaagaagcagcugcgggagaaugcggaagauaugggaaacggcugcuuuaaaauuuaucacaagugugacaaugccugcaucggguccauuagaaacggcaccuacgaucaugacguguaccgcgacgaggcucucaauaaccgguuccagaucaaaggagucgagcuuaagagcggcuauaaagauuggauccuguggauuucuuuugccaucuccugcuuccugcucuguguggcccugcugggguuuauuaugugggcuugccagaagggaaauaucagauguaacauuugcaucuga

SEQ ID NO: 184897 - RNA, 1701 nt, Artificial Sequence; identical to SEQ ID NO: 184880
  derived and/or modified sequence opt5 from hemagglutinin__InfluenzaA__ABU92726

SEQ ID NO: 184898 - RNA, 1701 nt, Artificial Sequence
  derived and/or modified sequence opt5 from hemagglutinin__InfluenzaA__ABU92727
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggacuucgauaagcuguacauuuggggaguccaccauccugggacggacaacgaucagaucucccucuaugcgcaggccagcggccgcauuacaguguccaccaaaagaucucaacagacaguuaucccgaauauugggagccggccccgcgugagagacaucccuucccggaucagcauuuacuggaccaucgucaagcccggagacauucugcugaucaacucuaccggcaaucucauugcuccucgcggguacuuuaaaaucagauccggaaagagcucuaucaugcggagcgaugcccccauuggcaaguguaacuccgagugcaucacaccgaauggcucuauuccuaacgacaaacccuuccagaaugugaaccgcaucacguauggggcuuguccuagauacgugaagcagaauacccugaaacuugccacaggaaugcggaacguccccgaaaagcaaacccgcggcauuuuuggggcgaucgccggauucaucgagaauggcugggaagggaugguugauggaugguauggcuuuagacaccagaacagcgagggcauugggcaggcugccgaccugaaauccacacaagcugccaucgaucagauuaauggaaagcucaaccggcugaucggcaaaaccaaugagaaguuccaccagauugaaaaggaguucagcgaaguggaggggagaauccaggaccuugaaaaauacguggaggauacgaagauugaccuguggucuuauaacgccgagcuccuggucgcucuggaaaaccaacauacaaucgaucucaccgacuccgagaugaauaaacuguuugaacgcaccaagaaacagcuucgggagaacgcggaagauaugggaaauggcugcuucaagaucuaccacaagugugacaacgccugcauugggagcaucagaaauggcacauaugaccaugauguguaccgcgacgaggcucugaacaaucgguuucagauuaaaggaguugagcucaagucuggcuacaaagauuggauccuguggauuuccuucgccaucagcugcuuucuucuguguguggcccuccugggguucaucaugugggcuugccagaagggaaacauuagauguaauaucugcauuuga

SEQ ID NO: 184899 - RNA, 1701 nt, Artificial Sequence
  derived and/or modified sequence opt5 from hemagglutinin__InfluenzaA__ABU92728
augaagaccaucauugcccugagcuacauccucugccagguguucgcucaaaaacugcccggcaacgacaauuccacagccacgcuuugucuggggcaccaugcggucccuaacggaaccauuguuaagacaaucaccaaugaucagauugaggugacaaacgcuaccgaacucgugcagaucucuagcacaggcgagaucugcgacuccccgcaccagauucuggauggggaaaauuguacccuuaucgacgcccugcucggagauccccaaugcgacggcuuucagaacaaaaagugggaucuguucgucgagagaucuaaagccuauagcaauuguuacccuuaugacgugcccgauuacgcuucccugcggucucucguugccagcuccgggacgcuggaauuuaacaaugagagcuucgacuggaccggagugacacagaacggcaccucuuccgcuugcaagcgcagaagcgauaagucuuucuucucccggcuuaauuggcugacacaucucaaauauaaguacccugcccugaacgucaccaugcccaauaacgagaaauuugacaagcuguauauuuggggcgugcaccauccugggacggauaaugaccagaucagccuguacgcgcaagccucuggacgcauuacaguuuccaccaaaagaagccagcagacagugaucccgaacauuggcucccggccccgcgucagagacgugucuagccggaucuccaucuacuggaccauugugaagccuggggauauccuccugauuaacagcaccggaaaucugaucgcuccccgcggcuauuucaagauuagaucugggaaauccagcaucaugcggucugacgccccuaucggaaaguguaacagcgaaugcauuacacccaauggcuccaucccgaacgauaaaccuuuucagaaugucaaccgcauuacguacggcgcuugucccagauauguuaagcaaaauacccucaaacuggccacagggaugcggaacgugccugagaagcagacccgcggaaucuucggcgcgauugccggguuuaucgaaaauggaugggagggcaugguggacgggugguacggauucagacaccagaacucugagggcacaggccaagcugccgaucuuaaaagcacccaggcugccaucaaucagauuaacgggaagcugaaucggcucaucggaaagacgaacgaaaaauuucaccagauugagaaggaauuuuccgaggucgaaggcagaauccaagaccuggagaaauauguggaggauacaaagauugaccuuuggagcuacaaugccgaacugcucguugcucuggagaaccagcauaccaucgaucugaccgacucugaaaugaacaaacucuucgagcgcacaaagaagcagcugcgggaaaaugcggaggauauggggaacggaugcuuuaaaauuuaucacaagugugacaaugccugcaucggcuccaucagaaacgggaccuacgaccaugauguguaccgcgacgaggcucuuaauaaccgguuccagauuaaaggcgucgaacuuaagagcggauauaaagauuggauccucuggauuucuuuugccaucuccugcuuccugcuuuguguggcccugcucggcuuuauuaugugggcuugccaaaaggggaauaucagauguaacaucugcauuuga

SEQ ID NO: 184900 - RNA, 1701 nt, Artificial Sequence; identical to SEQ ID NO: 184899
  derived and/or modified sequence opt5 from hemagglutinin__InfluenzaA__ABU92729

SEQ ID NO: 184901 - RNA, 1701 nt, Artificial Sequence; identical to SEQ ID NO: 184777
  derived and/or modified sequence opt5 from hemagglutinin__InfluenzaA__ABU92730

SEQ ID NO: 184902 - RNA, 1701 nt, Artificial Sequence
  derived and/or modified sequence opt5 from hemagglutinin__InfluenzaA__ABU92731
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacgucuggggagugcaccauccugggacguauaacgaucagauuucccucuacgcgcaggccagcggccgcaucacaguuuccaccaaaagaucucaacagacagugauuccgaauaucgggagccggccccgcgucagagacauuccuucccggaucagcaucuacuggaccauugugaagcccggagauauccugcugauuaacucuaccggcaaucucaucgcuccucgcggguauuuuaaaauuagauccggaaagagcucuaucaugcggagcgacgcccccaucggcaaguguaacuccgaaugcauuacaccgaauggcucuaucccuaacgacaaacccuuccagaaugugaaccgcauuacguacggggcuuguccuagauaugucaagcagaauacccugaaacuugccacaggaaugcggaacguucccgagaagcaaacccgcggcaucuuuggggcgauugccggauucaucgaaaauggcugggaggggaugguggauggaugguacggcuuuagacaccagaacagcgagggcaucgggcaggcugccgaccugaaauccacacaagcugccauugaucagaucaauggaaagcucaaccggcugauuggcaaaaccaaugaaaaguuccaccagaucgagaaggaguucagcgaaguggaagggcgcauucaggaccuugagaaauaugucgaggauacgaagaucgaccuguggucuuacaacgccgaacuccugguggcucuggagaaccaacauacaauugaucucaccgacuccgaaaugaauaaacuguuugagagaaccaagaaacagcuucgggaaaacgcggaggauaugggaaauggcugcuucaagaucuaucacaagugugacaacgccugcaucgggagcauuagaaauggcacauacgaucaugacguuuaccgcgacgaggcucugaacaaucgguuucagaucaaaggaguggaacucaagucuggcuauaaagauuggauucuguggaucuccuucgccauuagcugcuuucuucugugugucgcccuccugggguucaucaugugggcuugccagaagggaaacaucagauguaauauuugcaucuga

SEQ ID NO: 184903 - RNA, 1701 nt, Artificial Sequence
  derived and/or modified sequence opt5 from hemagglutinin__InfluenzaA__ABU92732
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacuccagcuuuuucucucggcugaauuggcucacacaucugaaguuuaaauauccugcccuuaacgugaccaugcccaauaacgaggaguucgacaagcuguacauuuggggaguccaccauccugggacguauaacgaucagaucucccucuacgcgcaggccagcggccgcauuacaguguccaccaaaagaucucaacagacaguuaucccgaauauugggagccggccccgcgugagagacaucccuucccggaucagcauuuacuggaccaucgucaagcccggagauauucugcugaucaacucuaccggcaaucucauugcuccucgcggguauuuuaaaaucagauccggaaagagcucuaucaugcggagcgacgcccccauuggcaaguguaacuccgaaugcaucacaccgaauggcucuauuccuaacgacaaacccuuccagaaugugaaccgcaucacguacggggcuuguccuagauaugugaagcagaauacccugaaacuugccacaggaaugcggaacguccccgagaagcaaacccgcggcauuuuuggggcgaucgccggauucaucgaaaauggcugggaggggaugguugauggaugguacggcuuuagacaccagaacagcgagggcauugggcaggcugccgaccugaaauccacacaagcugccaucgaucagauuaauggaaagcucaaccggcugaucggcaaaaccaaugaaaaguuccaccagauugagaaggaguucagcgaaguggaagggagaauccaggaccuugagaaauauguggaggauacgaagauugaccuguggucuuacaacgccgaacuccuggucgcucuggagaaccaacauacaaucgaucucaccgacuccgaaaugaauaaacuguuugagcgcaccaagaaacagcuucgggaaaacgcggaggauaugggaaauggcugcuucaagaucuaucacaagugugacaacgccugcauugggagcaucagaaauggcacauacgaucaugacguguaccgcgacgaggcucugaacaaucgguuucagauuaaaggaguugaacucaagucuggcuauaaagauuggauccuguggauuuccuucgccaucagcugcuuucuucugugugugguccuccugggguucaucaugugggccugccagaagggaaacauuagauguaauaucugcauuuga

SEQ ID NO: 184904 - RNA, 1701 nt, Artificial Sequence
  derived and/or modified sequence opt5 from hemagglutinin__InfluenzaA__ABU92733
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucaucgaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucccuagccggaucuccauuuacuggaccaucgucaaacccggagacauucugcugaucaauagcaccggcaaccucauugcuccucgcggguacuuuaagaucagaucuggaaaguccagcaucaugcggucugacgcccccauuggcaaauguaauagcgagugcaucacaccgaacggcuccauuccuaaugauaagcccuuccagaacgugaaucgcaucacguauggggcuuguccuagauacgugaaacagaacacccugaagcuggccacaggaaugcggaauguccccgaaaaacaaacccgcggcauuuuuggggcgaucgccggauucaucgagaacggcugggaagggaugguugacggaugguauggcuuuagacaccaaaauucugagggcauugggcaggcugccgaucuuaagagcacacaggcugccaucaaccagauuaauggaaaacucaaccggcugaucggcaagaccaacgagaaguuccaccagauugaaaaagaguucuccgaaguggaggggagaauccaggaccuugaaaaguacguggaggauacgaaagucgaccuguggagcuauaaugccgagcuccugguggcucuggaaaaccaacauacaauugaucucaccgacucugagaugaauaagcuguuugaacgcaccaaaaagcagcuucgggagaacgcggaagauaugggaaauggcugcuucaagaucuaccacaaaugugacaacgccugcaucggguccauuagaaauggcacauauaaccaugauguuuaccgcgacgaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 184905 - RNA, 1701 nt, Artificial Sequence; identical to SEQ ID NO: 184777
  derived and/or modified sequence opt5 from hemagglutinin__InfluenzaA__ABU92734

SEQ ID NO: 184906 - RNA, 1701 nt, Artificial Sequence
  derived and/or modified sequence opt5 from hemagglutinin__InfluenzaA__ABU92735
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcggaucuccgcaccagauccuugacggcgagaauuguacccugauugaugcccuccugggggacccccagugcgauggauuucaaaacaaaaagugggaccuguucgucgaaagaagcaaagccuauuccaauuguuacccuuaugaugugcccgacuacgcuucucuccggagccugguugccuccagcggcacgcuugaguuuaacaaugaaucuuucaacuggaccggcgugacacagaaugggaccuccagcgcuugcaagcgcagaucuaacaauuccuuuuucagccggcugaacuggcucacacaucugaaguuuaaauauccugcccuuaaugucaccaugcccaacaacgagaaguucgauaaacuguacaucuggggagugcaccauccuggcacggacaaugaucagauuucucucuaugcgcaggccccggcucgcaucacaguuuccaccaagagaagccaacagacagugauucccaacaucgggucccggccucgcgucagagacauucccucucggaucagcaucuacuggaccauugugaaaccuggagauauccugcugauuaauuccaccggcaaccucaucgcuccccgcggguacuuuaagauucugagcggaaagucuuccaucaugagaagcgacgccccgaucggcaaauguaauucugagugcauuacaccuaacggcagcauccccaaugacaagccuuuccagaacgugaaucggauuacguauggggccuguccccgcuacgucaaacagaacacccuuaagcuggcgacaggaaugagaaauguucccgaaaaacaaacccggggcaucuuuggggccauugcuggauucaucgagaacggcugggaagggaugguggauggaugguauggcuuucgccaccaaaauuccgagggcaucgggcaggccgcugaccucaagucuacacaggccgccauuaaccagaucaauggaaaacugaacagacuuauuggcaagaccaacgagaaguuccaccagaucgaaaaagaguucagcgaaguggaggggcggauucaggaucuggaaaaguacgucgaggacacgaaaaucgaucucugguccuauaaugcugagcugcugguggcgcucgaaaaccaacauacaauugaccugaccgauagcgagaugaauaaacuuuuugaaagaaccaagaagcagcugcgcgagaacgccgaagacaugggaaauggcugcuucaagaucuaccacaaaugugauaacgcuugcaucgggucuauucggaauggcacauaugaccaugauguuuacagagacgaggcccucaacaaucgcuuucagaucaagggaguggagcugaaauccggcuacaaggacuggauucuuuggaucagcuucgccaugucuugcuuucugcucugugucgcucugcugggguucauuaugugggccugccagaaaggaaacauccgguguaauaucugcauuuga

SEQ ID NO: 184907 - RNA, 1701 nt, Artificial Sequence; identical to SEQ ID NO: 184852
  derived and/or modified sequence opt5 from hemagglutinin__InfluenzaA__ABU92737

SEQ ID NO: 184908 - RNA, 1701 nt, Artificial Sequence
  derived and/or modified sequence opt5 from hemagglutinin__InfluenzaA__ABU92738
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccccgggccgcauuacaguguccaccaagagaagccaacagacaguuauccccaacauugggucccggccucgcgugagagauauccccucucggaucagcauuuacuggaccaucgucaaaccuggagacauucugcugaucaauuccaccggcaaccucauugcuccccgcggguacuuuaagaucagaagcggaaagucuuccaucaugcggagcgacgccccgauuggcaaauguaauucugagugcaucacaccuaacggcagcauucccaaugauaagccuuuccagaacgugaaucgcaucacguauggggcuugucccagauacgugaaacagaacacccugaaacuugccacaggaaugcggaauguccccgaaaagcaaacccgcggcauuuuuggggcgaucgccggauucaucgagaacggcugggaagggaugguugacggaugguauggcuuuagacaccaaaauuccgagggcauugggcaggcugccgaucugaagucuacacaggcugccaucgaccagauuaacggaaaacucaaucggcugaucggcaagaccaacgagaaguuccaccagauugaaaaagaguucagcgaaguggaggggagaauccaggaucuugaaaaguacguggaggacacgaaaauugaucugugguccuauaacgccgagcuccuggucgcucuggaaaaucaacauacaaucgaccucaccgauagcgagaugaacaagcuguuugaacgcaccaaaaagcagcuucgggagaaugcggaagacaugggaaacggcugcuucaagaucuaccacaaaugugauaaugccugcauugggucuaucagaaacggcacauaugaccaugacguguaccgcgaugaggcucugaauaaccgguuucagauuaagggaguugagcucaaauccggcuacaaggacuggauccuguggauuagcuucgccaucucuugcuuucuucugugugugguccuccugggguucaucaugugggccugccagaaaggaaauauuagauguaacaucugcauuuga

SEQ ID NO: 184909 - RNA, 1701 nt, Artificial Sequence; identical to SEQ ID NO: 184786
  derived and/or modified sequence opt5 from hemagglutinin__InfluenzaA__ABU92739

SEQ ID NO: 184910 - RNA, 1701 nt, Artificial Sequence
  derived and/or modified sequence opt5 from hemagglutinin__InfluenzaA__ABU92740
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacacgcuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcaagcgcagaucuaacaauuccuuuuucagccggcugaacuggcucacccaucugaaguuuaaauauccugcucuuaaugucacgaugcccaacaacgagaaguucgacaaacuguacaucuggggcgugcaccauccugggacagauaaugaccagauuuuucucuaugcccaggcgucuggacgcaucaccguuuccacaaagagaagccaacagaccgugauuccgaacaucggcucccggccccgcgucagaaauauuccuucucggaucagcaucuacuggaccauugugaaacccggggauauccugcugauuaacuccacaggaaaucucaucgccccucgcggcuacuucaagauuagaagcgggaagucuuccaucaugcggagcgacgcucccaucggaaaauguaacucugaaugcauuacgccgaauggcagcaucccuaacgacaagcccuuucagaaugugaaccgcauuaccuauggcgccuguccuagauacgucaaacagaauacacugaaacuugcuaccgggaugcggaacguucccgagaaacaaacacgcggaaucuucggcgccauugcgggguuuaucgaaaauggaugggagggcaugguggaugggugguauggauucagacaccagaacuccgagggcaucggccaggccgcugaccugaagucuacccaagccgcuauuaaucagaucaacgggaaacucaaccggcugauuggaaagacgaaugaaaaguuccaccagaucgagaaagaauuuagcgagguggaaggccgcauucaggaucuugagaaguacgucgaggacacaaaaaucgaucugugguccuauaacgccgaacuccugguggcccuggagaaucaacauaccauugaccucaccgauagcgaaaugaacaagcuguucgagagaacaaagaagcagcuucgggaaaaugcugaggacauggggaacggaugcuuuaagaucuaccacaaaugugauaaugcgugcaucggcucuauuagaaacgggaccuaugaccaugauguuuaccgcgacgaggcccugaauaaccgguuccagaucaagggcguggaacucaaauccggauacaaggacuggauucuguggaucagcuuugcuauuucuugcuuccuucugugugucgcccuccugggcuuuaucaugugggccugccagaaagggaauaucagauguaacauuugcaucuga

SEQ ID NO: 184911 - RNA, 1701 nt, Artificial Sequence
  derived and/or modified sequence opt5 from hemagglutinin__InfluenzaA__ABU92741
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucucucucuaugcgcaggccccgggccgcauuacaguguccaccaaaagaagccaacagacaguuauccccaacauugggucccggccucgcgugagagauauccccucucggaucagcauuuacuggaccaucgucaagccuggagacauucugcugaucaauuccaccggcaaccucauugcuccccgcggguacuuuaaaaucagaagcggaaagucuuccaucaugcggagcgacgccccgauuggcaaguguaauucugaaugcaucacaccuaacggcagcauucccaaugauaaaccuuuccagaacgugaaucgcaucacguauggggcuugucccagauacgugaagcagaacacccugaaacuugccacaggaaugcggaauguccccgagaagcaaacccgcggcauuuuuggggcgaucgccggauucaucgaaaacggcugggaggggaugguugacggaugguauggcuuuagacaccaaaauuccgagggcauugggcaggcugccgaucugaaaucuacacaggcugccaucgaccagauuaacggaaagcucaaucggcugaucggcaaaaccaacgaaaaguuccaccagauugagaaggaguucagcgaaguggaagggagaauccaggaucuugagaaauacguggaggacacgaagauugaucugugguccuauaacgccgaacuccuggucgcucuggagaaucaacauacaaucgaccucaccgauagcgaaaugaacaaacuguuugagcgcaccaagaaacagcuucgggaaaaugcggaggacaugggaaacggcugcuucaagaucuaccacaagugugauaaugccugcauugggucuaucagaaacggcacauaugaccaugacauuuaccgcgaugaggcucugaauaaccgguuucagaucaaaggaguggaacucaaguccggcuacaaagacuggauucuguggaucagcuucgccaucucuugcuuucuucuguguguugugcuccugggguucauuaugugggccugccagaagggaaauaucagauguaacauuugcaucuga

SEQ ID NO: 184912 - RNA, 1701 nt, Artificial Sequence; identical to SEQ ID NO: 184852
  derived and/or modified sequence opt5 from hemagglutinin__InfluenzaA__ABU92742

SEQ ID NO: 184913 - RNA, 1701 nt, Artificial Sequence
  derived and/or modified sequence opt5 from hemagglutinin__InfluenzaA__ABU92743
augaagaccaucauugcccugagcuacauccucuaucugguguucgcucagaaacuucccgagaacgacaauuccacagccacgcugugccucggccaccaugcggucccuaacgggaccauuguuaagacaaucaccaaugaucaaauugaagugacaaacgcuaccgagcuggugcagucuagcuccacaggaggcaucugugacucuccgcaccagauccuugauggggaaaauugcacccugauugacgcccuccugggagauccccagugugacggcuuucaaaacaaaaagugggaucuguucgucgagagaagcaaagccuacuccaauugcuauccuuacgacgugcccgauuaugcuucucuccggagccugguugccuccagcgggacgcuugaauuuaacaaugagucuuucaacuggaccggagugacacagaauggcaccuccagcgcuuguaagcgcagaucuaacaauuccuuuuucagccggcugaacuggcucacacaucugaaguuuaaauacccugcccuuaaugucaccaugcccaacaacgagaaguucgacaaacuguauaucuggggcgugcaccauccugggacggauaaugaccagauuuuucucuacgcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuauuucaagauuagaagcgggaagucuuccaucaugcggagcgacgcccccaucggaaaaugcaacucugaauguauuacaccgaauggcagcaucccuaacgacaagcccuuucagaaugugaaccgcauuacguacggcgcuugcccuagauaugucaaacagaauacccugaaacuugccacagggaugcggaacguucccgagaagcaaacccgcggaaucuucggcgcgauugccggguuuaucgaaaauggaugggagggcaugguggaugggugguacggauucagacaccagaacuccgagggcaucggccaggcugccgaccugaagucuacacaagcugccauugaucagaucaaugggaaacucaaccggcugauuggaaagaccaacgaaaaguuccaccagaucgagaaagaauuuagcgagguggaaggccgcauucaggaccuugagaaguaugucgaggauacgaaaaucgaccugugguccuacaaugccgaacuccugguggcucuggagaaccaacauacaauugaucucaccgacagcgaaaugaauaagcuguucgagaaaaccaagaagcagcuuagagaaaacgcggaggauauggggaauggauguuuuaaaaucuaucacaagugcgacaacgccuguaucggcucuauucggaaugggacauacgaucaugacguuuacagagacgaggcucugaacaaucgcuuccagaucaaaggcguggaacucaaguccggauauaaagauuggauucuguggaucagcuuugccauuucuugcuuccuucugugcgucgcccuccugggcuuuaucaugugggcuugucagaaggggaacauccggugcaauauuuguaucuga

SEQ ID NO: 184914 - RNA, 1701 nt, Artificial Sequence; identical to SEQ ID NO: 184852
  derived and/or modified sequence opt5 from hemagglutinin__InfluenzaA__ABU92744

SEQ ID NO: 184915 - RNA, 1701 nt, Artificial Sequence
  derived and/or modified sequence opt5 from hemagglutinin__InfluenzaA__ABU92745
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucucucucuaugcgcaggccccgggccgcauuacaguguccaccaaaagaagccaacagacaguuauccccaacauugggucccggccucgcgugagagauauccccucucggaucagcauuuacuggaccaucgucaagccuggagacauucugcugaucaauuccaccggcaaccucauugcuccccgcggguacuuuaaaaucagaaucggaaagagcucuauuaugcgguccgacgccccgaucggcaaguguaauagcgaaugcauuacaccuaacggcucuauccccaaugauaaaccuuuccagaacgugaaucgcauuacguauggggcuugucccagauacgugaagcagaacacccugaaacuugccacaggaaugcggaauguccccgagaagcaaacccgcggcaucuuuggggcgaucgccggauucauugaaaacggcugggaggggaugguugacggaugguauggcuuuagacaccagaauagcgagggcaucgggcaggcugccgaucugaaauccacacaagcugccauugaccagaucaacggaaagcucaaucggcugauuggcaaaaccaacgaaaaguuccaccagaucgagaaggaguucucugaaguggaagggcgcauucaggaucuugagaaauacguggaggacacgaagaucgaucuguggagcuauaacgccgaacuccuggucgcucuggagaaucaacauacaaucgaccucaccgauuccgaaaugaacaaacuguuugagagaaccaagaaacagcuucgggaaaaugcggaggacaugggaaacggcugcuucaagauuuaccacaagugugauaaugccugcaucgggagcauuagaaacggcacauaugaccaugacguguaccgcgaugaggcucugaauaaccgguuucagaucaaaggaguugaacucaagucuggcuacaaagacuggauucuguggaucuccuucgccaucagcugcuuucuucugugugugguccuccugggguucauuaugugggccugccagaagggaaauaucagauguaacauuugcaucuga

SEQ ID NO: 184916 - RNA, 1701 nt, Artificial Sequence; identical to SEQ ID NO: 184852
  derived and/or modified sequence opt5 from hemagglutinin__InfluenzaA__ABU92746

SEQ ID NO: 184917 - RNA, 1701 nt, Artificial Sequence; identical to SEQ ID NO: 183097
  derived and/or modified sequence opt5 from hemagglutinin__InfluenzaA__ABU92747

SEQ ID NO: 184918 - RNA, 1701 nt, Artificial Sequence
  derived and/or modified sequence opt5 from hemagglutinin__InfluenzaA__ABU92748
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacauucuaaguuuaaauauccugcccugaaugucaccaugcccaacaacgagaaguucgacaaacuuuacaucuggggcgugcaccauccugggacggauaaugaccagacauuucuguaugcgcaggccuccggacgcauuaccguuagcacaaagagaucccaacagaccgugaucccgaacauuggcucucggccccgcgucagaaauaucccuagccggauuuccaucuacuggaccaucgugaaacccggggauauucuccugaucaacagcacaggaaaucugauugcuccucgcggcuacuucaagaucagaucugggaaguccagcauuaugcggucugacgcccccaucggaaaauguaacagcgaaugcaucacgccgaauggcuccauuccuaacgacaagcccuuucagaaugugaaccgcaucaccuauggcgcuuguccuagauacgucaaacagaauacacucaagcuggccaccgggaugcggaacguucccgagaaacaaacacgcggaauuuucggcgcgaucgccggguuuauugaaaauggaugggagggcaugguggaugggugguauggauucagacaccagaacucugagggcaucggccaggcugccgaccuuaagagcacccaagcugccaucaaucagauuaacgggaaacugaaccggcucaucggaaagacgaaugaaaaguuccaccagauugagaaagaauuuuccgagguggaaggcagaauccaggaucuggagaaguacgucgaggacacaaaaauugaucuuuggagcuauaacgccgaacugcucguggcucuggagaaucaacauaccaucgaccugaccgauucugaaaugaacaaacucuucgagcgcacaaagaagcagcugcgggaaaaugcggaggacauggggaacggaugcuuuaagauuuaccacaaaugugauaaugccugcaucggcuccaucagaaacgggaccuaugaccaugauguuuaccgcgacgaggcucuuaauaaccgguuccagauuaagggcguggaacugaaaagcggauacaaggacuggauccucuggauuucuuuugccaucuccugcuuccugcuuugugucgugcugcucggcuuuauuaugugggccugccagaaagggaauaucagauguaacaucugcauuuga

SEQ ID NO: 184919 - RNA, 1701 nt, Artificial Sequence; identical to SEQ ID NO: 183097
  derived and/or modified sequence opt5 from hemagglutinin__InfluenzaA__ABU92749

SEQ ID NO: 184920 - RNA, 1701 nt, Artificial Sequence
  derived and/or modified sequence opt5 from hemagglutinin__InfluenzaA__ABU92750
augaagaccaucauugcccugagcuacauccucugccugguguucgcucagaaacuucccggcaacgacaauagaacagccacgcugugucucgggcaccaugcggucccuaacggaaccauuguuaagacaaucaccaaugaucaaauugaggugacaaacgcuaccgaacuggugcagaucuccucuacaggcgggaucugcgacagcccgcaccagauucuugauggagagaauuguacccugaucgacgcccuccugggcgauccccagugcgacggguuucaaaacaaaaagugggaucuguucgucgaacgguccaaagccuauucuaauuguuacccuuaugacgugcccgauuacgcuagccuccgcucccugguugccucuagcggaacgcuugaguuuaacaaugaauccuucgacuggaccggcgugacacagaacggcaccagcucugcuugcaagagacgguccaauaagagcuuuuucucucgccugaacuggcucacacaucugaaauauaaguacccugcccuuaaugucaccaugcccaacaaugagaaauuugauaagcuguauauuuggggagugcaccauccugggacggacuccgaucagaucagccucuacgcgcaggccucuggcagaauuacaguuuccaccaaacggagccaacagacagugaucccgaacauugggucccgccccagaguccgggacgugucuagccgcaucuccaucuacuggaccauugugaagccuggagacauccugcugauuaacagcaccggcaaucucaucgcucccagaggguauuucaagauucggucuggaaaauccagcaucaugcgcucugaugccccuaucggcaaguguaacagcgagugcauuacacccaauggcuccaucccgaacgacaaaccuuuucagaaugucaacagaauuacguacggggcuuguccccgguauguuaagcagaauacccugaaacuugccacaggaaugcgcaacgugccugaaaagcaaaccagaggcaucuucggggcgauugccggauuuaucgagaauggcugggaagggaugguggauggaugguacggcuuccggcaccagaacucugagggcacagggcaggcugccgaccugaaaagcacccaagcugccaucaaucagauuaacggaaagcucaauagacugaucggcaagacgaacgagaaauuucaccagauugaaaaggaguucuccgaagucgaggggcgcauccaggaucuugaaaaauauguggaggacacaaagauugaucuguggagcuacaaugccgagcuccugguugcucuggaaaaccaacauaccaucgaccucaccgauucugagaugaacaaacuguucgaacggacaaagaagcagcuuagagagaaugcggaagacaugggaaacggcugcuuuaaaauuuaucacaagugugauaaugccugcaucggguccauccgcaacggcaccuacgaccaugacguguaccgggaugaggcucugaauaacagauuccagauuaaaggagucgagcucaagagcggcuauaaagacuggauccuguggauuucuuuugccaucuccugcuuccuucuguguguggcccuccugggguuuauuaugugggcuugccagaagggaaauauccgcuguaacaucugcauuuga

SEQ ID NO: 184921 - RNA, 1701 nt, Artificial Sequence
  derived and/or modified sequence opt5 from hemagglutinin__InfluenzaA__ABU92751
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauauaaguacccugcccuuaacgucaccaugcccaauaacgagaaauuugacaagcuguauaucuggggagugcaccauccugggacggauucugaccagauuucccucuacgcgcaggccagcggccgcaucacaguuuccaccaaaagaucucaacagacagugauuccgaacaucgggagccggccccgcgucagagauguguccagccggauuucuaucuacuggaccaucgugaagccuggagacauucugcugaucaauuccaccggcaaccucauugcuccccgcggguauuucaagaucagaagcggaaaaucuagcauuaugcgguccgacgccccuaucggcaaguguaauucugagugcaucacacccaacggcagcauuccgaaugauaaaccuuuucagaacgucaaucgcaucacguacggggcuugucccagauauguuaagcagaacacccugaaacuugccacaggaaugcggaaugugccugaaaagcaaacccgcggcauuuucggggcgaucgccggauuuauugagaacggcugggaagggaugguggacggaugguacggcuucagacaccaaaauuccgagggcacagggcaggcugccgaucugaaaagcacccaggcugccaucaaccagaucaauggaaagcucaaccggcugauuggcaagacgaaugagaaauuucaccagaucgaaaaggaguucucugaagucgaggggcgcauucaggaccuugaaaaauauguggaggauacaaagaucgaccugugguccuacaacgccgagcuccugguugcucuggaaaaccaacauaccauugaucucaccgacagcgagaugaauaaacuguucgaaagaacaaagaagcagcuucgggagaacgcggaagauaugggaaauggcugcuuuaaaaucuaucacaagugugacaacgccugcauugggucuaucagaaauggcaccuacgaucaugacguguaccgcgacgaggcucugaacaaucgguuccagaucaaaggagucgagcucaaguccggcuauaaagauuggauucuguggaucagcuuugccauuuccugcuuccuucuguguguggcccuccugggguuuaucaugugggcuugccagaagggaaacauuagauguaauaucugcaucuga

SEQ ID NO: 184922 - RNA, 1701 nt, Artificial Sequence; identical to SEQ ID NO: 184786
  derived and/or modified sequence opt5 from hemagglutinin__InfluenzaA__ABU92752

SEQ ID NO: 184923 - RNA, 1701 nt, Artificial Sequence; identical to SEQ ID NO: 183097
  derived and/or modified sequence opt5 from hemagglutinin__InfluenzaA__ABU92753

SEQ ID NO: 184924 - RNA, 1701 nt, Artificial Sequence; identical to SEQ ID NO: 184786
  derived and/or modified sequence opt5 from hemagglutinin__InfluenzaA__ABU92754

SEQ ID NO: 184925 - RNA, 1701 nt, Artificial Sequence
  derived and/or modified sequence opt5 from hemagglutinin__InfluenzaA__ABU92755
augaagaccaucauugcccugagcuacauccucugccugguguucgcucagaaacuucccggcaacgacaaugggacagccacgcugugucucggacaccaugcggucccuaacggcaccauuguuaagacaaucaccaaugaucaaauugaggugacaaacgcuaccgaacuggugcaguccucuagcacagggggaaucugcgacuccccgcaccagauccuugauggcgagaauuguacccugauugacgcccuccugggggauccccagugcgacggauuucaaaacaaaaagugggaucuguucgucgaaagaucuaaagccuauagcaauuguuacccuuaugacgugcccgauuacgcuucccuccggucucugguugccagcuccggcacgcuugaguuuaacaaugaaucuuucaacuggaccggcgugacacagaaugggaccucuuccgcuugcaagcgcagaagcaacaagagcuuuuucucccggcugaauuggcucacacaucugaaauuuaaguauccugcccuuaacgucaccaugcccaauaacgagaaauucgacaagcuguacaucuggggagugcaccauccuggcacggauaacgaccagauuagccucuaugcgcaggccucugggcgcaucacaguuuccaccaaaagaagccaacagacagugauuccgaauaucggaucccggccccgcgucagagaugugccuucucggauuagcaucuacuggaccaucgugaagcccggcgacauucugcugaucaacuccaccgggaaucucauugcuccucgcggauacuuuaagaucagaagcggcaaaucuuccauuaugcggagcgacgcccccaucggcaaguguaacucugagugcaucacaccgaaugggagcauuccuaacgauaaacccuuccagaaugucaaccgcaucacguauggagcuuguccuagauacguuaagcagaauacccugaaacuugccacaggcaugcggaacgugcccgaaaagcaaacccgcgggauuuuuggagcgaucgccggcuucauugagaaugggugggaaggaaugguggacggcugguauggcuuuagacaccagaacgcugaggggacaggacaggccgcugaucugaaauccacccaagccgccaucaaucagaucaacggcaagcucaaucggcugauugggaagacgaacgagaaauuccaccagaucgaaaaggaguucucugaagucgagggacgcauucaggaccuugaaaaauacguggaggauacaaagaucgaccuguggagcuauaacgcugagcuccugguugcgcuggaaaaucaacauaccauugaucucaccgacuccgagaugaacaaacuguuugaaagaacaaagaagcagcuucgggagaaugccgaagauaugggcaacgggugcuucaaaaucuaccacaagugugacaaugcuugcauuggcagcaucagaaacggaaccuaugaucauaauguguaccgcgacgaggcccugaacaaucgguuucagaucaaaggcgucgagcucaagucuggguacaaagacuggauucuguggaucuccuucgccauuagcugcuuucuucugugugugguucuccugggauucaucaugugggcuugccagaagggcaacauuagauguaauaucugcaucuga

SEQ ID NO: 184926 - RNA, 1701 nt, Artificial Sequence
  derived and/or modified sequence opt5 from hemagglutinin__InfluenzaA__ABU92756
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagcccauagcaauuguuauccuuacgacgugcccgauuaugcuucccuccggucucugguugccagcuccggaacgcuugaguuuaacaaugaaucuuucgacuggaccggcgugacacagaacggcaccucuuccgcuugcaagcgcagaagcaauaagagcuuuuucucccggcugaacuggcucacacaccugaaauacaaguauccugcccuuaaugucaccaugcccaacaaugagaaauuugauaagcuguacauuuggggagugcaucacccugggacggacagcgaucagaucucucucuaugcgcaggccuccggccgcauuacaguuagcaccaaaagaucccaacagacagugaucccgaacauugggucucggccccgcgucagagacgugagcucccggaucagcaucuacuggaccauugugaagccuggagacauccugcugauuaacucuaccggcaaucucaucgcuccccgcggguacuucaagauuagauccggaaaaagcucuaucaugcggagcgaugccccuaucggcaaguguaacuccgagugcauuacacccaauggcucuaucccgaacgacaaaccuuuucagaaugucaaccgcauuacguauggggcuugucccagauacguuaagcagaauacccugaaacuugccacaggaaugcggaacgugccugaaaagcaaacccgcggcaucuucggggcgauugccggauuuaucgagaauggcugggaagggaugguggauggaugguauggcuucagacaccagaacagcgagggcacagggcaggcugccgaccugaaauccacccaagcugccaucaaucagauuaacggaaagcucaaucggcugaucggcaagacgaacgagaaauuucaucagauugaaaaggaguucagcgaagucgaggggagaauccaggaucuugaaaaauacguggaggacacaaagauugaucuguggucuuauaaugccgagcuccugguugcucuggaaaaccaacacaccaucgaccucaccgauuccgagaugaacaaacuguucgaacgcacaaagaagcagcuucgggagaaugcggaagacaugggaaacggcugcuuuaaaauuuaccauaagugugauaaugccugcaucgggagcaucagaaacggcaccuaugaccacgacguguaccgcgaugaggcucugaauaaccgguuccagauuaaaggagucgagcucaagucuggcuacaaagacuggauccuguggauuuccuuugccaucagcugcuuccuucuguguguggcccuccugggguuuauuaugugggcuugccagaagggaaauaucagauguaacaucugcauuuga

SEQ ID NO: 184927 - RNA, 1701 nt, Artificial Sequence
  derived and/or modified sequence opt5 from hemagglutinin__InfluenzaA__ABU92757
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcgacuccccgcaccagauucuugauggggaaaauuguacccugaucgacgcccuccugggagauccccagugcgacggcuuucaaaacaaaaagugggaucuguucgucgagagaucuaaagccuauagcaauuguuacccuuaugacgugcccgauuacgcuucccuccggucucugguugccagcuccgggacgcuugaauuuaacaaugagagcuucgacuggaccggagugacacagaacggcaccucuuccgcuugcaagcgcagaagcgauaagucuuucuucucccggcugaauuggcucacacaucugaaauauaaguacccugcccuuaacgucaccaugcccaauaacgagaaauuugacaagcuguauauuuggggcgugcaccauccugggacggauagcgaccagaucucucucuacgcgcaggccuccggacgcauuacaguuagcaccaaaagaucccaacagacagugaucccgaauauuggcucucggccccgcgucagagacgugagcucccggaucagcaucuacuggaccauugugaagccuggggauauccugcugauuaacucuaccggaaaccucaucgcuccccgcggcuauuucaagauuagacgggggaaauccagcaucaugcgcucugacgccccuaucggaaaguguaauagcgaaugcauuacacccaacggcuccaucccgaaugauaaaccuuuucagaacgucaauagaauuacguacggcgcuuguccccgguauguuaagcagaacacccugaaacuugccacagggaugcgcaaugugccugagaagcaaaccagaggaaucuucggcgcgauugccggguuuaucgaaaacggaugggagggcaugguggacgggugguacggauuccggcaccaaaauucugagggcacaggccaggcugccgaucugaaaagcacccaggcugccaucaaccagauuaaugggaagcucaacagacugaucggaaagacgaaugaaaaauuucaccagauugagaaggaauuuuccgaggucgaaggccgcauccaggaccuugagaaauauguggaggauacaaagauugaccuguggagcuacaacgccgaacuccugguugcucuggagaaucaacauaccaucgaucucaccgacucugaaaugaacaaacuguucgagcggacaaagaagcagcuuagagaaaacgcggaggauauggggaauggaugcuuuaaaauuuaucacaagugugacaacgccugcaucggcuccauccgcaaugggaccuacgaccaugauguguaccgggacgaggcucugaacaauagauuccagauuaaaggcgucgaacucaagagcggauauaaagauuggauccuguggauuucuuuugccaucuccugcuuccuucuguguguggcccuccugggcuuuauuaugugggcuugccagaaggggaacauccgcuguaauaucugcauuuga

SEQ ID NO: 184928 - RNA, 1701 nt, Artificial Sequence; identical to SEQ ID NO: 184786
  derived and/or modified sequence opt5 from hemagglutinin__InfluenzaA__ABU92758

SEQ ID NO: 184929 - RNA, 1701 nt, Artificial Sequence; identical to SEQ ID NO: 184786
  derived and/or modified sequence opt5 from hemagglutinin__InfluenzaA__ABU92759

SEQ ID NO: 184930 - RNA, 1701 nt, Artificial Sequence
  derived and/or modified sequence opt5 from hemagglutinin__InfluenzaA__ABU92760
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgagaucugcaauuccccgcaccagauucuugacggggaaaacuguacccugaucgaugcccuccugggagacccccagugcgauggcuuucaaaauaaaaagugggaccuguucgucgagagaucuaaagccuauagcaacuguuacccuuaugaugugcccgacuacgcuucccuccggucucugguugccagcuccgggacgcuugaauuuaauaacgagagcuucgauuggaccggagugacacagaauggcaccucuuccgcuugcaagcgcagaagcgacaagucuuucuucucccggcugaacuggcucacacaucugaaauauaaguacccugcccuuaaugucaccaugcccaacaaugagaaauuugauaagcuguauauuuggggcgugcaccauccugggacggacagcgaucagaucucucucuacgcgcaggccuccggacgcauuacaguuagcaccaaaagaucccaacagacagugaucccgaacauuggcucucggccccgcgucagagacgugagcucccggaucagcaucuacuggaccauugugaagccuggggacauccugcugauuaacucuaccggaaaucucaucgcuccccgcggcuauuucaagauuagauccgggaaaagcucuaucaugcggagcgaugccccuaucggaaaguguaacuccgaaugcauuacacccaauggcucuaucccgaacgacaaaccuuuucagaaugucaaccgcauuacguacggcgcuugucccagauauguuaagcagaauacccugaaacuugccacagggaugcggaacgugccugagaagcaaacccgcggaaucuucggcgcgauugccggguuuaucgaaaauggaugggagggcaugguggaugggugguacggauucagacaccagaacagcgagggcacaggccaggcugccgaccugaaauccacccaagcugccaucaaucagauuaacgggaagcucaaucggcugaucggaaagacgaacgaaaaauuucaccagauugagaaggaauuuagcgaggucgaaggcagaauccaggaucuugagaaauauguggaggacacaaagauugaucuguggucuuacaaugccgaacuccugguugcucuggagaaccaacauaccaucgaccucaccgauuccgaaaugaacaaacuguucgagcgcacaaagaagcagcuucgggaaaaugcggaggacauggggaacggaugcuuuaaaauuuaucacaagugugauaaugccugcaucggcagcaucagaaacgggaccuacgaccaugacguguaccgcgaugaggcucugaauaaccgguuccagauuaaaggcgucgaacucaagucuggauauaaagacuggauccuguggauuuccuuugccaucagcugcuuccuucuguguguggcccuccugggcuuuauuaugugggcuugccagaaggggaauaucagauguaacaucugcauuuga

SEQ ID NO: 184931 - RNA, 1698 nt, Artificial Sequence
  derived and/or modified sequence opt5 from hemagglutinin__InfluenzaA__ABV29579
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagaagagaauggaaaaucucaacaagaaaguggacgauggauuucuggacauuuggaccuacaacgcugagcuucugguccuccuggaaaaugagcggacgcuugacuuccacgauagcaacgugaagaaucuguaugaaaaagucaagucucaacucaaaaacaaugcgaaggagaucggcaacgggugcuuugaguucuaccauaaguguaaugacgaaugcauggaguccgugaaaaacggcacauaugauuaccccaaguauagcgaagagucuaaacugaaucgcgagaagauugacggaguuaaacuggaauccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 184932 - RNA, 1698 nt, Artificial Sequence
  derived and/or modified sequence opt5 from hemagglutinin__InfluenzaA__ABV29612
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagguugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggaguuaagcuggaauccaugggcguguaccagauccucgccauuuauagcaccgucgcuuccucucuggugcuucugguuagccucggggccaucuccuuuuggaugugcucuaacggaagccugcagugucggaucugcauuuga

SEQ ID NO: 184933 - RNA, 1698 nt, Artificial Sequence
  derived and/or modified sequence opt5 from hemagglutinin__InfluenzaA__ABV29634
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaagccccgucccccgagaauggcaccuguuauccuggguacuuugccgacuaugaggaacugagagagcaacucucuagcgucuccagcuucgaacgguuugagaucuuccccaaggagucuuccuggccuaaccauacggugaccggaguuagcgcuucuugcucccacaauggcaagagcucuuuuuaccgcaaccugcuuuggcugacaggcaaaaaugggcucuaucccaaccuguccaagagcuacgccaauaacaaagaaaaggaggugcugguccucuggggagugcaucacccuccgaauaucggcgaucagagagcucuguaccacaccgaaaacgccuauguguccgucguuucuagccauuacucccggcgcuucacacccgagauugcgaaaagaccuaaggugcgggaccaggaagggcgcaucaacuauuacuggacccuucuggagcccggagauacgauuaucuuugaggccaauggcaaccucauugcuccuagauucgccuuugcucugagccggggguucggaucuggcaucauuacauccaaugcccccaugggcgaaugugacgcgaagugccagaccccgcaaggggccaucaacagcucucuuccuuuucagaaugugcaccccgucacaaucggagaguguccuaaauaugugcgcagcgcuaagcugagaaugguuaccggccuccggaacauucccuccauccagucucgcgggcuguucggagccauugcuggcuuuaucgaagggggauggaccggcaugguggauggcugguacggguaucaucaccagaaugagcaaggaagcggcuacgccgccgaccagaaauccacacagaacgcuauuaaugggaucacgaacaaggucaauagcgugaucgaaaagaugaacacccaguucacagcgguuggaaaagaguucaauaaacuggagagacggauggaaaaccucaauaagaagguggaugacggcuuucuggauauuuggaccuacaacgccgagcuucugguccuccuggaaaacgagcgcacacuugacuuccacgacucuaaugugaaaaaccuguaugaaaaggucaaaucccaacucaagaauaacgcuaaagagaucgggaauggcugcuuugaguucuaccauaaguguaacgaugaaugcauggagagcgugaagaauggaaccuaugacuaccccaaauauucugaagaguccaagcugaacagagagaaaauugauggcguuaagcuggaaagcauggggguguaccagauccucgccauuuauuccacggucgccucuagccuggugcuucugguuucccucggagcuaucucuuuuuggaugugcagcaauggcucccugcagugucggaucugcauuuga

SEQ ID NO: 184934 - RNA, 1698 nt, Artificial Sequence
  derived and/or modified sequence opt5 from hemagglutinin__InfluenzaA__ABV29645
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugaaaagaugaauacccaguucacagccguggggaaagaguucaacaaacuggagagacggauggaaaaucucaacaagaagguugacgauggauuucuggacaucuggaccuacaacgcugagcuucuggugcuccuggaaaaugagcgcacgcuugacuuccacgauagcaacgucaaaaaucuguaugaaaaggugaaaucucaacucaagaacaaugcgaaagagauuggcaacgggugcuuugaguucuaccauaaguguaaugacgaaugcauggaguccgucaagaacggcacauaugauuaccccaaauauagcgaagagucuaagcugaauagagagaaaaucgacggagugaagcuggaauccaugggcguuuaccagauucucgccaucuauagcaccguggcuuccucucugguccuucuggugagccucggggccaucuccuuuuggaugugcucuaacggaagccugcagugucggauuugcaucuga

SEQ ID NO: 184935 - RNA, 1698 nt, Artificial Sequence; identical to SEQ ID NO: 184934
  derived and/or modified sequence opt5 from hemagglutinin__InfluenzaA__ABV29667

SEQ ID NO: 184936 - RNA, 1698 nt, Artificial Sequence
  derived and/or modified sequence opt5 from hemagglutinin__InfluenzaA__ABV29678
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccguggacgaaugugaugccaagugccagacaccgcaaggcgcgaucaauuccagccuuccuuuucagaacgugcaccccgucaccauuggggaguguccuaaauaugugcgcucuaccaagcugagaaugguuacaggacuccggaauauccccagcauucagucccgcggccuguucggggccaucgcuggauuuauugaaggcggguggacgggaaugguggacggcugguacggcuaucaucaccagaacgagcaagggucuggauacgccgcugaucagaaaagcacccagaaugccaucaacggcaucacaaauaaggucaacuccgugauugaaaagaugaauacccaguucacagccguugggaaagaguucaacaaacuggagagacggauggaaaaucucaacaagaagguggacgauggauuucuggacaucuggaccuacaacgcugagcuucugguccuccuggaaaaugagcgcacgcuugacuuccacgauagcaacgugaaaaaucuguaugaaaaggucaaaucucaacucaagaacaaugcgaaagagauuggcaacgggugcuuugaguucuaccauaaguguaaugacgaaugcauggaguccgugaagaacggcacauaugauuaccccaaauauagcgaagagucuaagcugaauagagagaaaaucgacggaguuaagcuggaauccaugggcguguaccagauucucgccaucuauagcaccgucgcuuccucucuggugcuucugguuagccucggggccaucuccuuuuggaugugcucuaacggaagccugcagugucggauuugcaucuga

SEQ ID NO: 184937 - RNA, 1698 nt, Artificial Sequence
  derived and/or modified sequence opt5 from hemagglutinin__InfluenzaA__ABV29689
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggauuggaaugguggacggcugguacggcuaucaucaccagaacgagcaagggucuggauacgccgcugaucagaaaagcacgcagaaugccaucaacggcaucaccaauaaggucaacuccgugauugaaaagaugaauacacaguucaccgccguugggaaagaguucaacaaacuggagagacggauggaaaaucucaacaagaagguggacgauggauuucuggacaucuggacauacaacgcugagcuucugguccuccuggaaaaugagcgcacccuugacuuccacgauagcaacgugaaaaaucuguaugaaaaggucaaaucucaacucaagaacaaugcgaaagagauuggcaacgggugcuuugaguucuaccauaaguguaaugacgaaugcauggaguccgugaagaacggcacguaugauuaccccaaauauagcgaagagucuaagcugaauagagagaaaaucgacggaguuaagcuggaauccaugggcguguaccagauucucgccaucuauagcacagucgcuuccucucuggugcuucugguuagccucggggccaucuccuuuuggaugugcucuaacggaagccugcagugucggauuugcaucuga

SEQ ID NO: 184938 - RNA, 1698 nt, Artificial Sequence
  derived and/or modified sequence opt5 from hemagglutinin__InfluenzaA__ABV29700
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggaguuaagcuggaauccaugggcguguaccagauccucgccauuuauagcaccgucgcuuccucucuggugcuucugguuagccucggggccaucuccuuuuggaugugcucuaacggaagccugcagugucggaucugcauuuga

SEQ ID NO: 184939 - RNA, 1701 nt, Artificial Sequence
  derived and/or modified sequence opt5 from hemagglutinin__InfluenzaA__ABV29711
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaauccagagcgggaagucuuccaucaugagaagcgacgcccccauuggaaaguguaacucugaaugcaucacaccgaauggcagcauuccuaacgacaaacccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugguggaugggugguauggauuccgccaccagaacuccgagggcauuggccaagcugccgaccugaaaucuacacaggcugccaucgaucagauuaaugggaagcucaacagacugaucggaaaaaccaacgaaaaguuccaccagauugagaaggaauuuagcgagguggaaggccggauccaagaccuugagaaauacgucgaggauacgaagauugaccugugguccuauaaugccgaacuccugguggcucuggagaaccagcauacaaucgaucucaccgacagcgaaaugaauaaacuguucgagaagaccaaaaagcagcuuagagaaaacgcggaggauauggggaauggaugcuuuaagaucuaccacaaaugugacaacgccugcauuggcucuauccgcaaugggacauaugaucaugacguuuaccgggacgaggcucugaacaauagauuccagauuaagggcguggaacucaaauccggauacaaggauuggauccuguggauuagcuuugccaucucuugcuuccuucugugugucgcccuccugggcuuuaucaugugggcuugccaaaaagggaacauucgcuguaauaucugcauuuga

SEQ ID NO: 184940 - RNA, 1701 nt, Artificial Sequence
  derived and/or modified sequence opt5 from hemagglutinin__InfluenzaA__ABV29722
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuucuugagguggaaggcagaauccaggaccuggagaaauacgucgaggauacgaagauugaccucuggagcuauaaugccgaacugcugguggcucucgagaaccaacauacaaucgaucugaccgacuccgaaaugaauaaacuuuucgagaagaccaaaaagcagcugcgcgaaaacgcggaggauauggggaauggaugcuuuaagaucuaccacaaaugugacaacgccugcauuggcagcauccggaaugggacauaugaucaugacguuuacagagacgaggcucucaacaaucgcuuccagauuaagggcguggaacugaaaucuggauacaaggauuggauccuuuggauuuccuuugccaucagcugcuuccugcucugugucgcccugcugggcuuuaucaugugggcuugccagaaagggaacauucgguguaauaucugcauuuga

SEQ ID NO: 184941 - RNA, 1698 nt, Artificial Sequence
  derived and/or modified sequence opt5 from hemagglutinin__InfluenzaA__ABV29733
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcgaauccagcuuuuaccgcaaucugcuuuggcugaccggcaagaacgggcucuaucccaaucugucuaaauccuacgcuaacaauaaggagaaagaagugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccggagauacaauuaucuuugaagcgaacggcaaucucauugccccuagauucgcuuuugcccugucccggggguucggaagcggcaucauuaccucuaacgcucccauggacaagugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccacgauagcaacgugaaaaaucuguaugaaaaggucaaaucucaacucaagaacaaugcgaaagagaucggcaacgggugcuuugaguucuaccauaagugugacgaugaaugcauggaguccgugaagaauggcacauaugacuaccccaaauauagcgaagagucuaagcugaacagagagaaaauugauggaguuaagcuggaauccaugggcguguaccagauccucgccauuuauagcaccgucgcuuccucucuggugcuucugguuagccucggggccaucuccuuuuggaugugcucuaauggaagccugcagugucggaucugcauuuga

SEQ ID NO: 184942 - RNA, 1698 nt, Artificial Sequence; identical to SEQ ID NO: 184934
  derived and/or modified sequence opt5 from hemagglutinin__InfluenzaA__ABV29744

SEQ ID NO: 184943 - RNA, 1698 nt, Artificial Sequence
  derived and/or modified sequence opt5 from hemagglutinin__InfluenzaA__ABV29755
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgucccccgagaauggcacguguuauccuggguacuuugccgacuaugaggaacugagagagcaacucucuagcgucuccagcuucgaacgguuugagaucuuccccaaggagucuuccuggccuaaccauaccgugacaggaguuagcgccucuugcucccacaauggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaaugcucccaugggcaagugugacgccaaaugccagacaccgcaaggggcgaucaacagcucucuuccuuuucagaaugugcaccccgucaccaucggagaauguccuaaguaugugcgcagcgccaaacugagaaugguuaccggccuccggaacauucccuccauccagucucgcgggcuguucggagcuauugccggcuuuaucgaagggggauggacaggcaugguggauggcugguacggguaucaucaccagaaugaacaaggaagcggcuacgcugccgaccagaaguccacgcagaacgccauuaaugggaucaccaacaaagucaauagcgugaucgagaagaugaacacacaguucaccgcuguuggaaaagaguucaauaagcuggagagacggauggagaaccucaauaagaaaguggaugacggcuuucuggauauuuggacauacaacgcggaacuucugguccuccuggagaacgaacgcacccuugacuuccacgacucuaaugugaagaaccuguaugagaaagucaagucccaacucaaaaauaacgccaaggaaaucgggaauggcugcuuugaguucuaccauaaguguaacgaugagugcauggaaagcgugaaaaauggaacguaugacuaccccaaguauucugaggaauccaaacugaacagagagaagauugauggcguuaaacuggagagcauggggguguaccagauccucgcuauuuauuccacagucgccucuagccuggugcuucugguuucccucggagccaucucuuuuuggaugugcagcaauggcucccugcagugucggaucugcauuuga

SEQ ID NO: 184944 - RNA, 1698 nt, Artificial Sequence; identical to SEQ ID NO: 184934
  derived and/or modified sequence opt5 from hemagglutinin__InfluenzaA__ABV29766

SEQ ID NO: 184945 - RNA, 1698 nt, Artificial Sequence
  derived and/or modified sequence opt5 from hemagglutinin__InfluenzaA__ABV29777
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcgaauccagcuuuuaccgcaaucugcuuuggcugaccggcaagaacgggcucuaucccaaucugucuaaauccuacgcuaacaauaaggagaaagaagugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccggagauacaauuaucuuugaagcgaacggcaaucucauugccccuagauucgcuuuugcccugucccggggguucggaagcggcaucauuaccucuaacgcucccauggacaagugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggaguuaagcuggaauccaugggcguguaccagauccucgccauuuauagcaccgucgcuuccucucuggugcuucugguuagccucggggccaucuccuuuuggaugugcucuaacggaagccugcagugucggaucugcauuuga

SEQ ID NO: 184946 - RNA, 1698 nt, Artificial Sequence; identical to SEQ ID NO: 184934
  derived and/or modified sequence opt5 from hemagglutinin__InfluenzaA__ABV29788

SEQ ID NO: 184947 - RNA, 1698 nt, Artificial Sequence; identical to SEQ ID NO: 184938
  derived and/or modified sequence opt5 from hemagglutinin__InfluenzaA__ABV29799

SEQ ID NO: 184948 - RNA, 1701 nt, Artificial Sequence
  derived and/or modified sequence opt5 from hemagglutinin__InfluenzaA__ABV29821
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagguuuuucucuaugcgcaggccucuggacgcaucacaguguccaccaaaagaagccaacagacagucauuccgaacaucggcucccggccccgcgugagaaauauuccuucucggaucagcaucuacuggaccauugugaagcccggggauauccugcugauuaacuccaccggaaaucucaucgcuccucgcggcuacuucaaaauuagaagcgggaagucuuccaucaugcggagcgacgcccccaucggaaaguguaacucugaaugcauuacaccgaauggcagcaucccuaacgacaaacccuuucagaaugucaaccgcauuacguauggcgcuuguccuagauacguuaagcagaauacccugaaacuugccacagggaugcggaacgugcccgagaagcaaacccgcggaaucuucggcgcgauugccggguuuaucgaaaauggaugggagggcaugguggaugggugguauggauucagacaccagaacuccgagggcaucggccaggcugccgaccugaaaucuacacaagcugccauugaucagaucaaugggaagcucaaccggcugauuggaaaaaccaacgaaaaguuccaccagaucgagaaggaauuuagcgaggucgaaggccgcauucaggaccuugagaaauacguggaggauacgaagaucgaccugugguccuauaaugccgaacuccugguugcucuggagaaccaacauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcgucgaacucaaauccggauacaaggauuggauucuguggaucagcuuugccauuucuugcuuccuucuguguguggcccuccugggcuuuaucaugugggcuugccagaaagggaacaucaaguguaauauuugcaucuga

SEQ ID NO: 184949 - RNA, 1698 nt, Artificial Sequence; identical to SEQ ID NO: 184938
  derived and/or modified sequence opt5 from hemagglutinin__InfluenzaA__ABV29832

SEQ ID NO: 184950 - RNA, 1698 nt, Artificial Sequence; identical to SEQ ID NO: 184934
  derived and/or modified sequence opt5 from hemagglutinin__InfluenzaA__ABV29865

SEQ ID NO: 184951 - RNA, 1698 nt, Artificial Sequence; identical to SEQ ID NO: 184934
  derived and/or modified sequence opt5 from hemagglutinin__InfluenzaA__ABV29876

SEQ ID NO: 184952 - RNA, 1701 nt, Artificial Sequence
  derived and/or modified sequence opt5 from hemagglutinin__InfluenzaA__ABV29898
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaagggcguggaacucaaauccggauacaaggauuggauccuguggauuagcuuugccaucucuugcuuccuucugugugucgcccuccugggcuuuaucaugugggcuugccagaaagggaacauucgguguaauaucugcauuuga

SEQ ID NO: 184953 - RNA, 1701 nt, Artificial Sequence
  derived and/or modified sequence opt5 from hemagglutinin__InfluenzaA__ABV29909
augaagaccaucauugcccugagcuacauccucugccugguguucgcucagaaacuucccggcaacgacaauuccacagccacgcugugucucgggcaccaugcggucccuaacggaaccauuguuaagacaaucaccucugaucaaauugaggugacaaaugcuaccgaacuggugcagaacagcuccaucggcgggaucugcaauucuccgcaccagauucuugacggagagaacuguacacugaucgaugcccuccugggcgacccccagugcgauggguuucaaaauaaaaagugggaccuguucgucgaaagaagcaaagccuauuccaacuguuacccuuaugaugugcccgacuacgcuucucuccggagccugauugccuccagcggaacccuugaguuuaauaacgaaucuuucaauuggacgggcguuacccagaacggcacauccagcgcuugcaagcgcagaucuaauaacuccuuuuucagccggcugaauuggcucacccaucugaaguuuaaauauccugcccuuaacgugacaaugcccaacaaugaggaguucgauaagcuguacaucuggggaguccaccauccugggaccgacaacgaucagauuucucucuaugcgcaggccccgggccgcaucacgguguccacaaaaagaagccaacagaccguuauucccaauaucgggucccggccucgcgugagagacauccccucucggauuagcaucuacuggacaauugucaagccuggagauauccugcugauuaacuccaccggcaaucucaucgcuccccgcggguacuuuaaaaucagaagcggaaagucuuccauuaugcggagcgacgccccgaucgacaaguguaacucugaaugcauuaccccuaauggcagcauccccaacgauaaaccuuuccagaaugugaaccgcauuacauauggcgcuugucccagauacgugaagcagaauacgcugaaacuugccaccgggaugcggaacguccccgagaagcaaacacgcggaaucuuuggcgcgaucgccggguucauugaaaauggaugggagggcaugguugacgggugguauggauuuagacaccagaacuccgagggcaucggccaggcugccgaucugaaaucuacccaagcugccauugaccagaucaaugggaagcucaaccggcugauuggaaaaacaaacgaaaaguuccaccagaucgagaaggaguucagcgaaguggaaggccgcauucaggaucuugagaaauacguggaggacaccaagaucgaucugugguccuauaaugccgaacuccuggucgcucuggagaaccaacauacgaucgaccucacagauagcgaaaugaauaaacuguuugagagaaccaagaaacagcuucgggaaaacgcggaggacauggggaauggaugcuucaagauuuaccacaagugugauaacgccugcaucggcucuauuagaaaugggaccuaugaccaugacguguaccgcgaugaggcucugaacaaucgguuucagaucaaaggcguugaacucaaguccggauacaaagacuggauucuguggaucagcuucgccaucucuugcuuucuucuguguguggcccuccugggcuucauuaugugggcuugccagaaggggaacaucagauguaauauuugcaucuga

SEQ ID NO: 184954 - RNA, 1698 nt, Artificial Sequence
  derived and/or modified sequence opt5 from hemagglutinin__InfluenzaA__ABV29920
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccaugggcgaaugugacgccaagugccagacaccgcaaggggcgaucaauuccagccuuccuuuucagaacgugcaccccgucaccaucggagaguguccuaaauaugugcgcucugccaagcugagaaugguuaccggccuccggaauauucccagcauccagucccgcgggcuguucggagcuauugccggcuuuaucgaagggggauggacaggcaugguggauggcugguacggguaucaucaccagaacgagcaaggaucuggcuacgcugccgaccagaaaagcacgcagaaugccauuaacgggaucaccaauaaggucaacuccgugaucgaaaagaugaauacacaguucaccgcuguuggaaaagaguucaacaaacuggagagacggauggaaaaucucaacaagaagguggaugacggcuuucuggauauuuggacauacaacgcggagcuucugguccuccuggaaaaugagcgcacccuugacuuccacgacagcaacgugaaaaaucuguaugaaaaggucaaaucucaacucaagaacaaugccaaagagaucgggaacggcugcuuugaguucuaccauaaguguaaugaugaaugcauggaguccgugaagaacggaacguaugacuaccccaaauauagcgaagagucuaagcugaauagagagaaaauugauggcguuaagcuggaauccauggggguguaccagauccucgcuauuuauagcacagucgccuccucucuggugcuucugguuagccucggagccaucuccuuuuggaugugcucuaacggcagccugcagugucggaucugcauuuga

SEQ ID NO: 184955 - RNA, 1698 nt, Artificial Sequence; identical to SEQ ID NO: 184945
  derived and/or modified sequence opt5 from hemagglutinin__InfluenzaA__ABV29942

SEQ ID NO: 184956 - RNA, 1698 nt, Artificial Sequence; identical to SEQ ID NO: 184938
  derived and/or modified sequence opt5 from hemagglutinin__InfluenzaA__ABV29953

SEQ ID NO: 184957 - RNA, 1698 nt, Artificial Sequence; identical to SEQ ID NO: 184938
  derived and/or modified sequence opt5 from hemagglutinin__InfluenzaA__ABV29964

SEQ ID NO: 184958 - RNA, 1698 nt, Artificial Sequence; identical to SEQ ID NO: 184934
  derived and/or modified sequence opt5 from hemagglutinin__InfluenzaA__ABV29986

SEQ ID NO: 184959 - RNA, 1698 nt, Artificial Sequence; identical to SEQ ID NO: 184938
  derived and/or modified sequence opt5 from hemagglutinin__InfluenzaA__ABV29997

SEQ ID NO: 184960 - RNA, 1698 nt, Artificial Sequence; identical to SEQ ID NO: 184934
  derived and/or modified sequence opt5 from hemagglutinin__InfluenzaA__ABV30008

SEQ ID NO: 184961 - RNA, 1698 nt, Artificial Sequence; identical to SEQ ID NO: 184938
  derived and/or modified sequence opt5 from hemagglutinin__InfluenzaA__ABV30019

SEQ ID NO: 184962 - RNA, 1698 nt, Artificial Sequence; identical to SEQ ID NO: 184938
  derived and/or modified sequence opt5 from hemagglutinin__InfluenzaA__ABV30030

SEQ ID NO: 184963 - RNA, 1698 nt, Artificial Sequence
  derived and/or modified sequence opt5 from hemagglutinin__InfluenzaA__ABV30041
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaccgcgccccugcagcugggcaauuguagcguugcuggguggauccucggaaacccugagugcgaacugcuuauuuccaaagagucuuggagcuacaucguggaaacgccgaaucccgagaacggcaccuguuauccuggguacuuugccgacuaugaggaacugagagagcaacucuccucugucagcuccuucgaacgguuugagauuuuccccaaggagagcucuuggccuaaucauacagugaccggaguuuccgccagcugcucucacaacggcaaguccagcuuuuaccgcaaucugcuuuggcugacaggcaaaaacgggcucuaucccaaucugucuaaguccuacgcuaacaauaaagaaaaggaggugcugguccucuggggagugcaucacccuccgaacaucggcgaucagagagcccuguaccacaccgaaaacgcuuaugugagcgucguuuccucucauuacagccggcgcuucacgcccgagaucgccaaaagaccuaaggugcgggaccaggaagggcgcauuaauuauuacuggacacuucuggagcccggagauaccaucauuuuugaggcgaacggcaaucucaucgccccuagauucgcuuuugcccugucccggggguucggaagcggcauuaucacaucuaacgcucccaugggcgaaugugacgccaagugccagaccccgcaaggggcgauuaauuccagccuuccuuuucagaacgugcaccccgucaccaucggagaguguccuaaauaugugcgcucugccaagcugagaaugguuacaggccuccggaauauccccagcauucagucccgcgggcuguucggagcuaucgccggcuuuauugaagggggauggacgggcaugguggauggcugguacggguaucaucaccagaacgagcaaggaucuggcuacgcugccgaccagaaaagcacccagaaugccaucaacgggauuacaaauaaggucaacuccgugaucgaaaagaugaauacccaguucacagcuguuggaaaagaguucaacaaacuggagagacggauggaaaaucucaacaagaagguggaugacggcuuucuggauaucuggaccuacaacgcggagcuucugguccuccuggaaaaugagcgcacgcuugacuuccacgacagcaacgugaaaaaucuguaugaaaaggucaaaaaccaacucaagaauaacgccaaagagauugggaauggcugcuuugaguucuaccauaaguguaacgaugaaugcauggagucugugaagaauggaacauaugacuaccccaaauauuccgaagagagcaagcugaacagagagaaaaucgauggcguuaagcuggaaucuauggggguguaccagauucucgcuaucuauuccaccgucgccagcucccuggugcuucugauuucucucggagccaucagcuuuuggaugugcuccaauggcucucugcagugucggaucugcauuuga

SEQ ID NO: 184964 - RNA, 1701 nt, Artificial Sequence; identical to SEQ ID NO: 184952
  derived and/or modified sequence opt5 from hemagglutinin__InfluenzaA__ABV30063

SEQ ID NO: 184965 - RNA, 1701 nt, Artificial Sequence; identical to SEQ ID NO: 184952
  derived and/or modified sequence opt5 from hemagglutinin__InfluenzaA__ABV30074

SEQ ID NO: 184966 - RNA, 1698 nt, Artificial Sequence; identical to SEQ ID NO: 184938
  derived and/or modified sequence opt5 from hemagglutinin__InfluenzaA__ABV30085

SEQ ID NO: 184967 - RNA, 1698 nt, Artificial Sequence; identical to SEQ ID NO: 184938
  derived and/or modified sequence opt5 from hemagglutinin__InfluenzaA__ABV30096

SEQ ID NO: 184968 - RNA, 1698 nt, Artificial Sequence; identical to SEQ ID NO: 184934
  derived and/or modified sequence opt5 from hemagglutinin__InfluenzaA__ABV30107

SEQ ID NO: 184969 - RNA, 1698 nt, Artificial Sequence
  derived and/or modified sequence opt5 from hemagglutinin__InfluenzaA__ABV30129
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggaauuuugccgacuacgaggaacugagagagcaacucuccucugucagcuccuucgaacgguuugagaucuuccccaaggagagcucuuggccuaaccauaccgugacaggaguuuccgccagcugcucucacaauggcaaguccagcuuuuaucgcaaccugcuuuggcugaccggcaaaaaugggcucuaccccaaccugucuaaguccuaugcuaauaacaaagaaaaggaggugcugguccucuggggagugcaucacccuccgaacaucggcgaucagagagcccuguaccacacagaaaaugcuuacgugagcgucguuuccucucauuauagccggcgcuucacccccgagauugccaaaagaccuaaggugcgggaccaggaagggcgcaucaacuacuauuggacgcuucuggagcccggagauacaauuaucuuugaggcgaauggcaaccucauugccccuagauucgcuuuugcccugucccggggguucggaagcggcaucauuaccucuaaugcucccauggacgaaugugaugccaagugccagacaccgcaaggcgcgaucaacuccagccuuccuuuucagaaugugcaccccgucaccaucggggaguguccuaaauacgugcgcucugccaagcugagaaugguuaccggacuccggaacauucccagcauccagucccgcggccuguucggggcuauugccggauuuaucgaaggcggguggacaggaaugguggacggcugguauggcuaccaucaccagaaugagcaagggucuggauaugcugccgaucagaaaagcacgcagaacgccauuaauggcaucaccaacaaggucaauuccgugaucgaaaagaugaacacacaguucaccgcuguugggaaagaguucaauaaacuggagagacggauggaaaaccucaacaagaagguggacgauggauuucuggacauuuggacauacaaugcggagcuucugguccuccuggaaaacgagcgcacccuugacuuccacgauagcaaugugaaaaaccuguacgaaaaggucaaaucucaacucaagaauaacgccaaagagaucggcaaugggugcuuugaguucuaucauaaguguaacgacgaaugcauggaguccgugaagaauggcacguacgauuaucccaaauacagcgaagagucuaagcugaacagagagaaaauugacggaguuaagcuggaauccaugggcguguaucagauccucgcuauuuacagcacagucgccuccucucuggugcuucugguuagccucggggccaucuccuuuuggaugugcucuaauggaagccugcagugucggaucugcauuuga

SEQ ID NO: 184970 - RNA, 1698 nt, Artificial Sequence
  derived and/or modified sequence opt5 from hemagglutinin__InfluenzaA__ABV30140
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugaaacugggcaauuguucuguugcuggguggauucucggaaacccugagugcgaacugcuuaucagcaaggaguccuggucuuacauuguggaaaccccgaaucccgagaacggcacguguuauccuggguacuuugccgacuaugaggaacugcgggagcagcucagcuccgucucuagcuucgaacgcuuugagaucuuccccaaggaguccagcuggccuaaucauaccgugacaggaguuucugccuccugcagccacaacggcaaaucuuccuuuuacagaaaucugcuuuggcugaccggcaagaacgggcucuaucccaaucugagccggucuuacgcuaacaauaaagaaaaggaggugcugguccucuggggagugcaucacccuccgaacaucggcgaucaacgcgcccuguaccacacagaaaacgcuuauguguccgucguuagcucccauuacucuagacgguucacccccgagauugccaaacgcccuaaggugagagaccaggaagggcggaucaauuauuacuggacgcuucuggagcccggagauacaauuaucuuugaggcgaacggcaaucucauugccccucgcuucgcuuuugcccugagcagaggguucggauccggcaucauuaccagcaacgcucccauggacgaaugugaugccaagugccagacaccgcagggcgcgaucaauucuucccuuccuuuucaaaacgugcaccccgucaccaucggggaguguccuaaauaugugcggagcgccaagcugcgcaugguuaccggacucagaaauauucccucuauccagagccggggccuguucggggcuauugccggauuuaucgaaggcggguggacaggaaugguggacggcugguacggcuaucaucaccagaacgagcagggguccggauacgcugccgaucaaaaaucuacgcagaaugccauuaacggcaucaccaauaaggucaacagcgugaucgaaaagaugaauacacaguucaccgcuguugggaaagaguucaacaaacuggagcgcagaauggaaaaucucaacaagaagguggacgauggauuucuggacauuuggacauacaacgcggagcuucugguccuccuggaaaaugagcggacccuugacuuccacgauuccaacgugaaaaaucuguaugaaaaggucaaaagccagcucaagaacaaugccaaagagaucggcaacgggugcuuugaguucuaccauaaguguaaugacgaaugcauggagucugugaagaacggcacguaugauuaccccaaauauuccgaagagagcaagcugaauagagagaaaauugacggaguuaagcuggaaucuaugggcguguaccaaauccucgcuauuuauuccacagucgccagcucccuggugcuucugguuucucucggggccaucagcuuuuggaugugcuccaacggaucucugcagugucgcaucugcauuuga

SEQ ID NO: 184971 - RNA, 1698 nt, Artificial Sequence
  derived and/or modified sequence opt5 from hemagglutinin__InfluenzaA__ABV30151
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacuccggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaaugcucccaugggcgaaugugacgccaagugccagacaccgcaaggggcgaucaacagcucucuuccuuuucagaaugugcaccccgucaccaucggagaguguccuaaauaugugcgcagcgccaagcugagaaugguuaccggccuccggaacauucccuccauccagucucgcgggcuguucggagcuauugccggcuuuaucgaagggggauggacaggcaugguggauggcugguacggguaucaucaccagaaugagcaaggaagcggcuacgcugccgaccagaaauccacgcagaacgccauuaaugggaucaccaacaaggucaauagcgugaucgaaaagaugaacacacaguucaccgcuguuggaaaagaguucaauaaacuggagagacggauggaaaaccucaauaagaagguggaugacggcuuucuggauauuuggacauacaacgcggagcuucugguccuccuggaaaacgagcgcacccuugacuuccacgacucuaaugugaaaaaccuguaugaaaaggucaaaucccaacucaagaauaacgccaaagagaucgggaauggcugcuuugaguucuaccauaaguguaacgaugaaugcauggagagcgugaagaauggaacguaugacuaccccaaauauucugaagaguccaagcugaacagagagaaaauugauggcguuaagcuggaaagcauggggguguaccagauccucgcuauuuauuccacagucgccucuagccuggugcuucugguuucccucggagccaucucuuuuuggaugugcagcaauggcucccugcagugucggaucugcauuuga

SEQ ID NO: 184972 - RNA, 1698 nt, Artificial Sequence
  derived and/or modified sequence opt5 from hemagglutinin__InfluenzaA__ABV30162
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaccccgaaucccgagaacggcacguguuauccuggguacuuugccgacuaugaggaacugcgggagcaacucuccucugucagcuccuucgaacgcuuugagaucuuccccaaagagagcucuuggccuaaucauaccgugacaggaguuuccgccagcugcucucacaacggcaaguccagcuuuuacagaaaucugcuuuggcugaccggcaagaacgggcucuaucccaaucugucuaaauccuacgcuaacaauaaggaaaaagaggugcugguccucuggggagugcaucacccuccgaacaucggcgaucagcgggcccuguaccacacagaaaacgcuuaugugagcgucguuuccucucauuacagccgcagauucacccccgagauugccaagcggccuaaagugcgcgaccaggaagggagaaucaauuauuacuggacgcuucuggagcccggagauacaauuaucuuugaggcgaacggcaaucucauugccccucgguucgcuuuugcccugucccgcggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaguaugugagaucuaccaaacugcggaugguuacaggacuccgcaauauucccagcauccaguccagaggccuguucggggccauugcuggauuuaucgaaggcggguggacgggaaugguggacggcugguacggcuaucaucaccagaacgagcaagggucuggauacgccgcugaucaaaagagcacccagaaugccauuaacggcaucacaaauaaagucaacuccgugaucgaaaagaugaauacccaguucacagccguugggaaagaguucaacaagcuggagcggcgcauggaaaaucucaacaaaaagguggacgauggauuucuggacauuuggaccuacaacgcugagcuucugguccuccuggaaaaugagagaacgcuugacuuccacgauagcaacgugaagaaucuguaugaaaaagucaagucucagcucaaaaacaaugcgaaggagaucggcaacgggugcuuugaguucuaccauaaauguaaugacgaaugcauggaguccgugaagaacggcacauaugauuaccccaaguauagcgaagagucuaaacugaaucgggagaagauugacggaguuaaacuggaauccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 184973 - RNA, 1698 nt, Artificial Sequence; identical to SEQ ID NO: 184938
  derived and/or modified sequence opt5 from hemagglutinin__InfluenzaA__ABV30173

SEQ ID NO: 184974 - RNA, 1698 nt, Artificial Sequence; identical to SEQ ID NO: 184938
  derived and/or modified sequence opt5 from hemagglutinin__InfluenzaA__ABV30184

SEQ ID NO: 184975 - RNA, 1701 nt, Artificial Sequence; identical to SEQ ID NO: 184952
  derived and/or modified sequence opt5 from hemagglutinin__InfluenzaA__ABV30217

SEQ ID NO: 184976 - RNA, 1701 nt, Artificial Sequence; identical to SEQ ID NO: 184952
  derived and/or modified sequence opt5 from hemagglutinin__InfluenzaA__ABV30228

SEQ ID NO: 184977 - RNA, 1701 nt, Artificial Sequence
  derived and/or modified sequence opt5 from hemagglutinin__InfluenzaA__ABV30261
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaguggaggugacaaaugcuaccgaacugguccagucuagcuccacaggcgggaucugcgacucuccgcaccagauccuugauggagagaacuguacccugauugacgcccuccugggcgauccccagugcgacggguuucaaaauaaaaagugggaucuguucguggaaagaagcaaagccuauuccaacuguuacccuuaugacguucccgauuacgcuucucuccggagccugguggccuccagcggaacgcuugaguuuaauaacgaaucuuucaauugggcuggcgucacccagaacggcacauccagcgccugcaagcgcgggucuaauaacuccuuuuucagcagacugaauuggcucacccauucuaaguuuaaauauccugcgcugaacgugacaaugcccaauaacgaggaguucgacaaacuuuacaucuggggaguucaccauccuggcaccgauaacgaccagauuuuucuguaugcccaggcuuccgggcggaucacggugagcacaaagcgcucccaacagaccgucauuccgaauaucggaucuagaccccgggugcgcaacauuccuagcagaaucuccaucuacuggacaauugugaagcccggcgauauccuccugauuaauagcaccgggaaccugaucgccccucggggauacuucaaaauucgcucuggcaaguccagcaucaugagaucugacgcucccaucggcaaguguaauagcgaaugcauuaccccgaacggguccaucccuaaugacaaacccuuucagaacgucaaucggauuacauauggagccuguccucgcuacguuaagcagaacacgcucaaacuggcgaccggcaugagaaaugugcccgagaagcaaacacgggggaucuucggagccauugcuggcuuuaucgaaaacgggugggagggaaugguggauggcugguauggcuuccgccaccaaaauucugaggggaugggacaggccgcugaccuuaaaagcacccaggccgccaucgaucagauuaacggcaagcugaauagacucaucgggaaaacaaacgaaaaguuccaccagauugagaaggaauuuuccgaggucgaaggacggauccaggaccuggagaaauacguggaggauaccaagauugaccuuuggagcuauaacgcugaacugcucguugcgcuggagaaucaacauacgaucgaucugacagacucugaaaugaacaaacucuucgagaagaccaaaaagcagcugagagaaaaugccgaggauaugggcaacgggugcuuuaagauuuaccacaaaugugacaaugcuugcaucggcuccauccgcaacggaaccuaugaucaugacguguaccgggccgaggcccuuaauaacagauuccagauuaagggcgucgaacugaaaagcggguacaaggacuggauccucuggauuucuuuugcuaucuccugcuuccugcuuuguguggcccugcucggauuuauuaugugggcgugccagaaaggcaauauccgcuguaacaucugcauuuga

SEQ ID NO: 184978 - RNA, 1701 nt, Artificial Sequence
  derived and/or modified sequence opt5 from hemagglutinin__InfluenzaA__ABV30272
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagcaagcugaacuggcucacacaucugaaguuuaaauauccugcccuuaaugucaccaugcccaacaacgagaaguucgacaaacuguacauuuggggcgugcaccauccugggacggauaaugaccagaucuuucucuaugcgcaggccucuggacggauuacaguuuccaccaagcgcagccaacagacagugaucccgaacauuggcuccagaccccggguccgcaauaucccuucuagaaucagcauuuacuggaccaucgugaaacccggggauauucugcugaucaacuccaccggaaaucucauugcuccucggggcuacuucaagauccgcagcgggaagucuuccaucaugagaagcgacgcccccauuggaaaauguaacucugaaugcaucacaccgaauggcagcauuccuaacgacaagcccuuucagaaugugaaccggaucacguauggcgcuuguccucgcuacgucaaacagaauacccugaaacuugccacagggaugagaaacguucccgagaagcaaacccggggaauuuucggcgcgaucgccggguuuaucgaaaauggaugggagggcaugguggaugggugguauggauuccgccaccagaacuccgagggcauuggccaggcugccgaccugaagucuacacaagcugccaucgaucagauuaaugggaaacucaacagacugaucggaaagaccaacgaaaaguuccaccagauugagaaagaauuuagcgagguggaaggccggauccaggaccuugagaaguacgucgaggauacgaaaauugaccugugguccuauaaugccgaacuccugguggcucuggagaaccaacauacaaucgaucucaccgacagcgaaaugaauaagcuguucgagaaaaccaagaagcagcuuagagaaaacgcggaggauauggggaauggaugcuuuaaaaucuaccacaagugugacaacgccugcauuggcucuauccgcaaugggacauaugaucaugacguuuaccgggacgaggcucugaacaauagauuccagauuaaaggcguggaacucaaguccggauacaaagauuggauccuguggauuagcuuugccaucucuugcuuccuucugugugucgcccuccugggcuuuaucaugugggcuugccagaaggggaacauucgcuguaauaucugcauuuga

SEQ ID NO: 184979 - RNA, 1698 nt, Artificial Sequence
  derived and/or modified sequence opt5 from hemagglutinin__InfluenzaA__ABV30283
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggaauuuugccgacuacgaggaacugagagagcaacucuccucugucagcuccuucgaacgguuugagaucuuccccaaggagagcucuuggccuaaccauaccgugacaggaguuuccgccagcugcucucacaauggcaaguccagcuuuuaucgcaaccugcuuuggcugaccggcaaaaaugggcucuaccccaaccugucuaaguccuaugcuaauaacaaagaaaaggaggugcugguccucuggggagugcaucacccuccgaacaucggcgaucagagagcccuguaccacacagaaaaugcuuacgugagcgucguuuccucucauuauagccggcgcuucacccccgagauugccaaaagaccuaaggugcgggaccaggaagggcgcaucaacuacuauuggacgcuucuggagcccggagauacaauuaucuuugaggcgaauggcaaccucauugccccuagauucgcuuuugcccugucccggggguucggaagcggcaucauuaccucuaaugcucccauggacgaaugugaugccaagugccagacaccgcaaggcgcgaucaacuccagccuuccuuuucagaaugugcaccccgucaccaucggggaguguccuaaauacgugcgcucugccaagcugagaaugguuaccggacuccggaacauucccagcauccagucccgcggccuguucggggcuauugccggauuuaucgaaggcggguggacaggaaugguggacggcugguauggcuaccaucaccagaaugagcaagggucuggauaugcugccgaucagaaaagcacgcagaacgccauugacggcaucaccaauaaggucaacuccgugaucgaaaagaugaauacacaguucaccgcuguugggaaagaguucaacaaacuggagagacggauggaaaaucucaacaagaagguggaugacggauuucuggacauuuggacauacaacgcggagcuucugguccuccuggaaaaugagcgcacccuugauuuccacgacagcaacgugaaaaaucuguacgaaaaggucaaaucucaacucaagaacaaugccaaagagaucggcaacgggugcuuugaguucuaucauaaguguaaugaugaaugcauggaguccgugaagaacggcacguacgacuaucccaaauacagcgaagagucuaagcugaauagagagaaaauugauggaguuaagcuggaauccaugggcguguaucagauccucgcuauuuacagcacagucgccuccucucuggugcuucugguuagccucggggccaucuccuuuuggaugugcucuaacggaagccugcagugucggaucugcauuuga

SEQ ID NO: 184980 - RNA, 1698 nt, Artificial Sequence
  derived and/or modified sequence opt5 from hemagglutinin__InfluenzaA__ABV30294
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagccggucuuacgcuaacaauaaggaaaaagaggugcugguccucuggggagugcaucacccuccgaacaucggcgaucagcgcgcccuguaccacacagaaaacgcuuauguguccgucguuagcucccauuacucuagacgguucacccccgagauugccaagcgcccuaaagugagagaccaggaagggcggaucaauuauuacuggacgcuucuggagcccggagauacaauuaucuuugaggcgaacggcaaucucauugccccucgcuucgcuuuugcccugagcagaggguucggauccggcaucauuaccagcaacgcucccauggacgaaugugaugccaagugccagacaccgcaaggcgcgaucaauucuucccuuccuuuucagaacgugcaccccgucaccaucggggaguguccuaaguaugugcggagcgccaaacugcgcaugguuaccggacucagaaauauucccucuauccagagccggggccuguucggggcuauugccggauuuaucgaaggcggguggacaggaaugguggacggcugguacggcuaucaucaccagaacgagcaaggguccggauacgcugccgaucagaagucuacgcagaaugccauuaacggcaucaccaauaaagucaacagcgugaucgaaaagaugaauacacaguucaccgcuguugggaaagaguucaacaagcuggagcgcagaauggaaaaucucaacaaaaagguggacgauggauuucuggacauuuggacauacaacgcggagcuucugguccuccuggaaaaugagcggacccuugacuuccacgauuccaacgugaagaaucuguaugaaaaagucaagagccaacucaaaaacaaugccaaggagaucggcaacgggugcuuugaguucuaccauaaauguaaugacgaaugcauggagucugugaagaacggcacguaugauuaccccaaguauuccgaagagagcaaacugaauagagagaagauugacggaguuaaacuggaaucuaugggcguguaccagauccucgcuauuuauuccacagucgccagcucccuggugcuucugguuucucucggggccaucagcuuuuggaugugcuccaacggaucucugcagugucgcaucugcauuuga

SEQ ID NO: 184981 - RNA, 1698 nt, Artificial Sequence
  derived and/or modified sequence opt5 from hemagglutinin__InfluenzaA__ABV30305
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaggcuccgccagcugcucucacaacggcaaguccagcuuuuaccgcaaucugcuuuggcugaccgggaaaaacggacucuaucccaaucugucuaaguccuacgcuaacaauaaagaaaaggagguucuggugcucuggggcguccaucacccuccgaacaucggggaucagagagcccuguaccacacagaaaacgcuuaugugagcguggucuccucucauuacagccggcgcuucacccccgagauugccaaaagaccuaagguucgggaccaggaaggacgcaucaauuauuacuggacgcuucuggagcccggcgauacaauuaucuuugaggcgaacgggaaucucauugccccuagauucgcuuuugcccugucccggggauucggcagcggcaucauuaccucuaacgcucccauggacgaaugugaugccaagugccagacaccgcaaggggcgaucaauuccagccuuccuuuucagaacgugcaccccgugaccaucggagaguguccuaaauauguccgcucuaccaagcugagaauggugacaggccuccggaauauucccagcauccagucccgcgggcuguucggagccauugcuggcuuuaucgaagggggauggacgggcaugguugacggcugguacggguaucaucaccagaacgagcaaggaucuggcuacgccgcugaucagaaaagcacccagaaugccauuaacgggaucacaaauaaggugaacuccgucaucgaaaagaugaauacccaguucacagccgugggaaaagaguucaacaaacuggagagacggauggaaaaucucaacaagaagguugacgauggcuuucuggacauuuggaccuacaacgcugagcuucuggugcuccuggaaaaugagcgcacgcuugacuuccacgauagcaacgucaaaaaucuguaugaaaaggugaaaucucaacucaagaacaaugcgaaagagaucgggaacggcugcuuugaguucuaccauaaguguaauaacgaaugcauggaguccgucaagaauggaacauaugacuaccccaaauauagcgaagagucuaagcugaacagagagaaaauugauggcgugaagcuggaauccauggggguuuaccagauccucgccauuuauagcaccguggcuuccucucugguccuucuggugagccucggagccaucuccuuuuggaugugcucuaauggcagccugcagugucggaucugcauuuga

SEQ ID NO: 184982 - RNA, 1698 nt, Artificial Sequence; identical to SEQ ID NO: 184934
  derived and/or modified sequence opt5 from hemagglutinin__InfluenzaA__ABV30316

SEQ ID NO: 184983 - RNA, 1698 nt, Artificial Sequence; identical to SEQ ID NO: 184980
  derived and/or modified sequence opt5 from hemagglutinin__InfluenzaA__ABV30327

SEQ ID NO: 184984 - RNA, 1698 nt, Artificial Sequence; identical to SEQ ID NO: 184934
  derived and/or modified sequence opt5 from hemagglutinin__InfluenzaA__ABV30338

SEQ ID NO: 184985 - RNA, 1698 nt, Artificial Sequence; identical to SEQ ID NO: 184938
  derived and/or modified sequence opt5 from hemagglutinin__InfluenzaA__ABV30349

SEQ ID NO: 184986 - RNA, 1698 nt, Artificial Sequence
  derived and/or modified sequence opt5 from hemagglutinin__InfluenzaA__ABV30360
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggaauuuugccgacuacgaggaacugagagagcaacucuccucugucagcuccuucgaacgguuugagaucuuccccaaggagagcucuuggccuaaccauaccgugacaggaguuuccgccagcugcucucacaauggcaaguccagcuuuuaucgcaaccugcuuuggcugaccggcaaaaaugggcucuaccccaaccugucuaaguccuaugcuaauaacaaagaaaaggaggugcugguccucuggggagugcaucacccuccgaacaucggcgaucagagagcccuguaccacacagaaaaugcuuacgugagcgucguuuccucucauuauagccggcgcuucacccccgagauugccaaaagaccuaaggugcgggaccaggaagggcgcaucaacuacuauuggacgcuucuggagcccggagauacaauuaucuuugaggcgaauggcaaccucauugccccuagauucgcuuuugcccugucccggggguucggaagcggcaucauuaccucuaaugcucccauggacgaaugugaugccaagugccagacaccgcaaggcgcgaucaacuccagccuuccuuuucagaaugugcaccccgucaccaucggggaguguccuaaauacgugcgcucugccaagcugagaaugguuaccggacuccggaacauucccagcauccagucccgcggccuguucggggcuauugccggauuuaucgaaggcggguggacaggaaugguggacggcugguauggcuaccaucaccagaaugagcaagggucuggauaugcugccgaucagaaaagcacgcagaacgccauugacggcaucaccaauaaggucaacuccgugaucgaaaagaugaauacacaguucaccgcuguugggaaagaguucaacaaacuggagagacggauggaaaaucucaacaagaagguggaugacggauuucuggacauuuggacauacaacgcggagcuucugguccuccuggaaaaugagcgcacccuugauuuccacgacagcaacgugaaaaaucuguacgaaaaggucaaaucucaacucaagaacaaugccaaagagaucggcaacgggugcuuugaguucuaucauaaguguaaugaugaaugcauggaguccgugaagaacggcacguacgacuaucccaaauacagcgaagagucuaagcugaauagagagaaaauugauggaaucaagcuggaauccaugggcguuuaucagauucucgcuaucuacagcacaguggccuccucucugguccuucuggugagccucggggccaucuccuuuuggaugugcucuaacggaagccugcagugucggauuugcaucuga

SEQ ID NO: 184987 - RNA, 1698 nt, Artificial Sequence; identical to SEQ ID NO: 184938
  derived and/or modified sequence opt5 from hemagglutinin__InfluenzaA__ABV30371

SEQ ID NO: 184988 - RNA, 1701 nt, Artificial Sequence; identical to SEQ ID NO: 184753
  derived and/or modified sequence opt5 from hemagglutinin__InfluenzaA__ABV30382

SEQ ID NO: 184989 - RNA, 1701 nt, Artificial Sequence; identical to SEQ ID NO: 183654
  derived and/or modified sequence opt5 from hemagglutinin__InfluenzaA__ABV30393

SEQ ID NO: 184990 - RNA, 1701 nt, Artificial Sequence
  derived and/or modified sequence opt5 from hemagglutinin__InfluenzaA__ABV30404
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaaguguuacccuuaugacgugcccgauuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaauauccugcccuuaacgucaccaugcccaauaacgagaaguucgacaaacuguacauuuggggcgugcaccauccugggacggauaacgaccagaucuuucucuaugcgcaggccucuggacgcauuacaguuuccaccaagagaagccaacagacagugaucccgaauauuggcucccggccccgcgucagaaacaucccuucucggaucagcauuuacuggaccaucgugaaacccggggauauucugcugaucaauuccaccggaaaccucauugcuccucgcggcuacuucaagaucagaagcgggaagucuuccaucaugcggagcgacgcccccauuggaaaauguaauucugaaugcaucacaccgaacggcagcauuccuaaugacaagcccuuucagaacgugaaucgcaucacguauggcgcuuguccuagauacgucaaacagaacacccugaaacuugccacagggaugcggaauguucccgagaaacaaacccgcggaauuuucggcgcgaucgccggguuuaucgaaaacggaugggagggcaugguggaugggugguauggauucagacaccaaaauuccgagggcauuggccaggcugccgaccugaagucuacacaggcugccaucgaucagauuaacgggaaacucaaucggcugaucggaaagaccaacgaaaaguuccaccagauugagaaagaauuuagcgagguggaaggcagaauccaggaccuugagaaguacgucgaggauacgaaaauugaccugugguccuauaacgccgaucuccugguggcucuggaaaaucaacauacaaucgaccucaccgauagcgagaugaacaagcuguucgaaaagaccaagaagcagcuucgcgagaaugcggaagacauggggaacggaugcuuuaaaaucuaccacaagugugauaaugccugcauuggcucuauccggaacgggacauaugaccaugacguuuacagagaugaggcucugaauaaccgcuuccagauuaaaggcguggagcucaaguccggauacaaagacuggauccuguggauuagcuuugccaucucuugcuuccuucugugugucgcccuccugggcuuuaucaugugggcuugccagaaggggaauauucgguguaacaucugcauuuga

SEQ ID NO: 184991 - RNA, 1701 nt, Artificial Sequence
  derived and/or modified sequence opt5 from hemagglutinin__InfluenzaA__ABV30415
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagucuagcuccacaggcgggaucugcgacucuccgcaccagauucuugauggagagaacuguacccugaucgacgcccuccugggcgauccccagugcgacggguuucaaaauaaaaagugggaucuguucgucgaaagaagcaaagccuauuccaacuguuacccuuaugacgugcccgauuacgcuucucuccggagccugguugccuccagcggaacgcuugaguuuaauaacgaaucuuucaauugggcuggcgugacccagaacggcacauccagcgccugcaagcgcgggucuaauaacuccuuuuucagcagacugaauuggcucacccauucuaaguuuaaauauccugcgcugaacgucacaaugcccaauaacgaggaguucgacaaacuuuacauuuggggagugcaccauccuggcaccgauaacgaccagaucuuucuguaugcccaggcuuccgggcggauuacgguuagcacaaagcgcucccaacagaccgugaucccgaauauuggaucuagaccccggguccgcaacaucccuagcagaaucuccauuuacuggacaaucgugaagcccggcgauauucuccugaucaauagcaccgggaaccugauugccccucggggauacuucaaaauccgcucuggcaaguccagcaucaugagaucugacgcucccauuggcaaguguaauagcgaaugcaucaccccgaacggguccauuccuaaugacaaacccuuucagaacgugaaucggaucacauauggagccuguccucgcuacgucaagcagaacacgcucaaacuggcgaccggcaugagaaauguucccgagaagcaaacacgggggauuuucggagccaucgcuggcuuuaucgaaaacgggugggagggaaugguggauggcugguauggcuuccgccaccaaaauucugaggggauuggacaggccgcugaccuuaaaagcacccaggccgccaucgaucagauuaacggcaagcugaauagacucaucgggaaaacaaacgaaaaguuccaccagauugagaaggaauuuuccgagguggaaggacggauccaggaccuggagaaauacgucgaggauaccaagauugaccuuuggagcuauaacgcugaacugcucguggcgcuggagaaucaacauacgaucgaucugacagacucugaaaugaacaaacucuucgagaagaccaaaaagcagcugagagaaaaugccgaggauaugggcaacgggugcuuuaagaucuaccacaaaugugacaaugcuugcauuggcuccauccgcaacggaaccuaugaucaugacguuuaccgggacgaggcccuuaauaacagauuccagauuaagagcguggaacugaaaucuggcuacaaggauuggauccucuggauuuccuuugccaucagcugcuuccugcuuugugucgcucugcucggguuuaucaugugggccugccagaaaggaaauauucgcuguaacaucugcauuuga

SEQ ID NO: 184992 - RNA, 1701 nt, Artificial Sequence; identical to SEQ ID NO: 184952
  derived and/or modified sequence opt5 from hemagglutinin__InfluenzaA__ABV30426

SEQ ID NO: 184993 - RNA, 1701 nt, Artificial Sequence
  derived and/or modified sequence opt5 from hemagglutinin__InfluenzaA__ABV30437
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaaccauuccuuuuucagccggcugaauuggcucacacaccugaaguuuaaguauccugcccuuaacgucaccaugcccaauaacgagaaauucgacaagcuguacauuuggggcgugcaucacccugggacggauaacgaccagaucuuucucuaugcgcaggccucuggacgcauuacaguuuccaccaaaagaagccaacagacagugaucccgaauauuggcucccggccccgcgucagaaacaucccuucucggaucagcauuuacuggaccaucgugaagcccggggauauucugcugaucaauuccaccggaaaccucauugcuccucgcggcuacuucaaaaucagaagcgggaagucuuccaucaugcggagcgacgcccccauuggaaaguguaauucugaaugcaucacaccgaacggcagcauuccuaaugacaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggaugggugguauggauucagacaccaaaauuccgagggcauuggccaggcugccgaccugaaaucuacacaggcugccaucgaucagauuaacgggaagcucaaucggcugaucggaaaaaccaacgaaaaguuccaucagauugagaaggaauuuagcgagguggaaggcagaauccaggaccuugagaaauacgucgaggauacgaagauugaccugugguccuauaacgccgaacuccugguggcucuggagaaucaacacacaaucgaucucaccgacagcgaaaugaacaaacuguucgagaagaccaaaaagcagcuucgcgaaaaugcggaggauauggggaacggaugcuuuaagaucuaccauaaaugugacaaugccugcauuggcucuauccggaacgggacauaugaucacgacguuuacagagacgaggcucugaauaaccgcuuccagauuaagggcguggaacucaaauccggauacaaggauuggauccuguggauuagcuuugccaucucuugcuuccuucugugugucgcccuccugggcuuuaucaugugggcuugccagaaagggaauauucgguguaacaucugcauuuga

SEQ ID NO: 184994 - RNA, 1701 nt, Artificial Sequence; identical to SEQ ID NO: 184952
  derived and/or modified sequence opt5 from hemagglutinin__InfluenzaA__ABV30448

SEQ ID NO: 184995 - RNA, 1698 nt, Artificial Sequence
  derived and/or modified sequence opt5 from hemagglutinin__InfluenzaA__ABV30459
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaagccccgaaucccgagaacggcaccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucuggugcucuggggaguccaucacccuccgaacauuggcgaucagagagcucuguaccacaccgaaaacgccuaugugagcguggucuccucucauuacagccggcgcuucacacccgagaucgcgaaaagaccuaagguucgggaccaggaagggcgcauuaauuauuacuggacccuucuggagcccggagauacgaucauuuuugaggccaacggcaaucucaucgcuccuagauucgccuuugcucugucccggggguucggaagcggcauuaucacaucuaacgcccccauggacgaaugugaugcgaagugccagaccccgcaaggcgccaucaauuccagccuuccuuuucagaacgugcaccccgugacaauuggggaguguccuaaauauguccgcucuaccaagcugagaauggugaccggacuccggaauauccccagcauucagucccgcggccuguucggggcuaucgccggauuuauugaaggcggguggacaggaaugguugacggcugguacggcuaucaucaccagaacgagcaagggucuggauacgcugccgaucagaaaagcacgcagaaugccaucaacggcaucaccaauaaggugaacuccgucauugaaaagaugaauacacaguucaccgcuguggggaaagaguucaacaaacuggagagacggauggaaaaucucaacaagaagguugacgauggauuucuggacaucuggacauacaacgcggagcuucuggugcuccuggaaaaugagcgcacccuugacuuccacgauagcaacgucaaaaaucuguaugaaaaggugaaaucucaacucaagaacaaugccaaagagauuggcaacgggugcuuugaguucuaccauaaguguaaugacgaaugcauggaguccgucaagaacggcacguaugauuaccccaaauauagcgaagagucuaagcugaauagagagaaaaucgacggagugaagcuggaauccaugggcguuuaccagauucucgcuaucuauagcacaguggccuccucucugguccuucuggugagccucggggccaucuccuuuuggaugugcucuaacggaagccugcagugucggauuugcaucuga

SEQ ID NO: 184996 - RNA, 1701 nt, Artificial Sequence; identical to SEQ ID NO: 184952
  derived and/or modified sequence opt5 from hemagglutinin__InfluenzaA__ABV30470

SEQ ID NO: 184997 - RNA, 1698 nt, Artificial Sequence; identical to SEQ ID NO: 184934
  derived and/or modified sequence opt5 from hemagglutinin__InfluenzaA__ABV30492

SEQ ID NO: 184998 - RNA, 1698 nt, Artificial Sequence
  derived and/or modified sequence opt5 from hemagglutinin__InfluenzaA__ABV30503
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccauuacaggagucuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguucucuggggagugcaucacccuccgaacaucggcgaucagagagcccuguaccacacagaaaacgcuuaugucagcgugguguccucucauuacagccggcgcuucacccccgagauugccaaaagaccuaagguccgggaccaggaagggcgcaucaauuauuacuggacgcuucuggagcccggagauacaauuaucuuugaggcgaacggcaaucucauugccccuagauucgcuuuugcccugucccggggguucggaagcggcaucaucaccucuaacgcucccauggacgaaugugaugccaagugccagacaccgcaaggcgcgauuaauuccagccuuccuuuucagaacguucaccccgugaccaucggggaguguccuaaauaugugcgcucuaccaagcugagaauggucacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccaucaacggcauuacaaauaagguuaacuccgugaucgaaaagaugaauacccaguucacagccgucgggaaagaguucaacaaacuggagagacggauggaaaaucucaacaagaagguggacgauggauuucuggacauuuggaccuacaacgcugagcuucugguucuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggagucaagcuggaauccaugggcguguaccagauccucgccaucuauagcaccguugcuuccucucuggugcuucuggucagccucggggccauuuccuuuuggaugugcucuaacggaagccugcagugucggaucugcauuuga

SEQ ID NO: 184999 - RNA, 1701 nt, Artificial Sequence; identical to SEQ ID NO: 184952
  derived and/or modified sequence opt5 from hemagglutinin__InfluenzaA__ABV30514

SEQ ID NO: 185000 - RNA, 1698 nt, Artificial Sequence
  derived and/or modified sequence opt5 from hemagglutinin__InfluenzaA__ABV30525
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacuccggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaauacacccaugggcgaaugugacgcuaagugccagaccccgcaaggggccaucaacagcucucuuccuuuucagaaugugcaccccgucaccaucggagaguguccuaaauaugugcgcagcgcgaagcugagaaugguuacaggccuccggaacauucccuccauccagucucgcgggcuguucggagccauugcuggcuuuaucgaagggggauggacgggcaugguggauggcugguacggguaucaucaccagaaugagcaaggaagcggcuacgccgcugaccagaaauccacccagaacgccauuaaugggaucacaaacaaggucaauagcgugaucgaaaagaugaacacccaguucacagccguuggaaaagaguucaauaaacuggagagacggauggaaaaccucaauaagaagguggaugacggcuuucuggauauuuggaccuacaacgcugagcuucugguccuccuggaaaacgagcgcacgcuugacuuccacgacucuaaugugaaaaaccuguaugaaaaggucaaaucccaacucaagaauaacgcgaaagagaucgggaauggcugcuuugaguucuaccauaaguguaacgaugaaugcauggagagcgugaagaauggaacauaugacuaccccaaauauucugaagaguccaagcugaacagagagaaaauugauggcguuaagcuggaaagcauggggguguaccagauccucgccauuuauuccaccgucgcuucuagccuggugcuucugguuucccucggagccaucucuuuuuggaugugcagcaauggcucccugcagugucggaucugcauuuga

SEQ ID NO: 185001 - RNA, 1698 nt, Artificial Sequence; identical to SEQ ID NO: 184938
  derived and/or modified sequence opt5 from hemagglutinin__InfluenzaA__ABV30536

SEQ ID NO: 185002 - RNA, 1698 nt, Artificial Sequence; identical to SEQ ID NO: 184945
  derived and/or modified sequence opt5 from hemagglutinin__InfluenzaA__ABV30547

SEQ ID NO: 185003 - RNA, 1698 nt, Artificial Sequence; identical to SEQ ID NO: 184938
  derived and/or modified sequence opt5 from hemagglutinin__InfluenzaA__ABV30558

SEQ ID NO: 185004 - RNA, 1698 nt, Artificial Sequence
  derived and/or modified sequence opt5 from hemagglutinin__InfluenzaA__ABV30569
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauaaccacaaugggaaacuuugccugcucaagggaauugcgccccugcagcugggcaacuguucuguggcuggguggauccucggaaauccugagugcgaacugcuuauuagcaaagaguccuggucuuacaucguugaaaccccgaaccccgagaauggcacguguuauccuggguacuuugccgacuaugaggaacugagagagcaacucagcuccgugucuagcuucgaacgguuugagaucuuccccaaggaguccagcuggccuaaccauaccgucacaggagugucugccuccugcagccacaauggcaagucuuccuuuuaccgcaaccugcuuuggcugaccggcaaaaaugggcucuaucccaaccugagcaagucuuacgcuaauaacaaagaaaaggagguucuggugcucuggggaguccaucacccuccgaacauuggcgaucagagagcccuguaccacacagaaaaugcuuauguguccguggucagcucccauuacucucggcgcuucacccccgagaucgccaaaagaccuaagguucgggaccaggaagggcgcauuaacuauuacuggacgcuucuggagcccggagauacaaucauuuuugaggcgaauggcaaccucaucgccccuagauucgcuuuugcccugagccggggguucggauccggcauuaucaccagcaaugcucccauggacgaaugugaugccaagugccagacaccgcaaggcgcgaucaacucuucccuuccuuuucagaaugugcaccccgugaccauuggggaguguccuaaauauguccgcagcaccaagcugagaauggugacaggacuccggaacauccccucuauucagagccgcggccuguucggggccaucgcuggauuuauugaaggcggguggacgggaaugguugacggcugguacggcuaucaucaccagaaugagcaaggguccggauacgccgcugaucagaaaucuacccagaacgccaucaauggcaucacaaacaaggugaauagcgucauugaaaagaugaacacccaguucacagccguggggaaagaguucaauaaacuggagagacggauggaaaaccucaacaagaagguugacgauggauuucuggacaucuggaccuacaaugcugagcuucuggugcuccuggaaaacgagcgcacgcuugacuuccacgauuccaaugucaaaaaccuguaugaaaaggugaaaagccaacucaagaauaacgcgaaagagauuggcaaugggugcuuugaguucuaccauaaguguaacgacgaaugcauggagucugucaagaauggcacauaugauuaccccaaauauuccgaagagagcaagcugaacagagagaaaaucgacggagugaagcuggaaucuaugggcguuuaccagauucucgccaucuauuccaccguggcuagcucccugguccuucuggugucucucggggccaucagcuuuuggaugugcuccaauggaucucugcagugucggauuugcaucuga

SEQ ID NO: 185005 - RNA, 1698 nt, Artificial Sequence; identical to SEQ ID NO: 184938
  derived and/or modified sequence opt5 from hemagglutinin__InfluenzaA__ABV30580

SEQ ID NO: 185006 - RNA, 1698 nt, Artificial Sequence; identical to SEQ ID NO: 184934
  derived and/or modified sequence opt5 from hemagglutinin__InfluenzaA__ABV30591

SEQ ID NO: 185007 - RNA, 1698 nt, Artificial Sequence; identical to SEQ ID NO: 184934
  derived and/or modified sequence opt5 from hemagglutinin__InfluenzaA__ABV30602

SEQ ID NO: 185008 - RNA, 1698 nt, Artificial Sequence
  derived and/or modified sequence opt5 from hemagglutinin__InfluenzaA__ABV30613
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugaaaagaugaauacccaguucacagccguggggaaagaguucaacaaacuggagagacggaugaagaaucucaacaagaaaguugacgauggauuucuggacaucuggaccuacaacgcugaacuucuggugcuccuggagaaugaacgcacgcuugacuuccacgauagcaacgucaagaaucuguaugagaaagugaagucucaacucaaaaacaaugcgaaggaaauuggcaacgggugcuuugaguucuaccauaaguguaaugacgagugcauggaauccgucaaaaacggcacauaugauuaccccaaguauagcgaggaaucuaaacugaauagagagaagaucgacggagugaaacuggaguccaugggcguuuaccagauucucgccaucuauagcaccguggcuuccucucugguccuucuggugagccucggggccaucuccuuuuggaugugcucuaacggaagccugcagugucggauuugcaucuga

SEQ ID NO: 185009 - RNA, 1698 nt, Artificial Sequence; identical to SEQ ID NO: 184934
  derived and/or modified sequence opt5 from hemagglutinin__InfluenzaA__ABV30624

SEQ ID NO: 185010 - RNA, 1701 nt, Artificial Sequence
  derived and/or modified sequence opt5 from hemagglutinin__InfluenzaA__ABV30646
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacguauaaugaucagaucuuucucuacgcgcaggccucuggacgcauuacaguuuccaccaaaagaagccaacagacagugaucccgaacauuggcucccggccccgcgucagaaauaucccuucucggaucagcauuuacuggaccaucgugaagcccggggacauucugcugaucaacuccaccggaaaucucauugcuccucgcggcuauuucaaaaucagaagcgggaagucuuccaucaugcggagcgaugcccccauuggaaaguguaacucugaaugcaucacaccgaauggcagcauuccuaacgacaaacccuuucagaaugugaaccgcaucacguacggcgcuuguccuagauaugucaagcagaauacccugaaacuugccacagggaugcggaacguucccgagaagcaaacccgcggaauuuucggcgcgaucgccggguuuaucgaaaauggaugggagggcaugguggacgggugguacggauucagacaccagaacuccgagggcauuggccaggcugccgaucugaaaucuacacaagcugccaucgaccagauuaaugggaagcucaaccggcugaucggaaaaaccaacgaaaaguuccaccagauugagaaggaauuuagcgagguggaaggcagaauccaggaucuugagaaauaugucgaggacacgaagauugaucugugguccuacaaugccgaacuccugguggcucuggagaaccaacauacaaucgaccucaccgauagcgaaaugaauaaacuguucgagaagaccaaaaagcagcuucgcgaaaacgcggaggacauggggaauggaugcuuuaagaucuaucacaaaugugauaacgccugcauuggcucuauccggaaugggacauacgaccaugauguuuacagagacgaggcucugaacaaucgcuuccagauuaagggcguggaacucaaauccggauauaaggacuggauccuguggauuagcuuugccaucucuugcuuccuucugugugucgcccuccugggcuuuaucaugugggcuugccagaaagggaacauucgguguaauaucugcauuuga

SEQ ID NO: 185011 - RNA, 1701 nt, Artificial Sequence
  derived and/or modified sequence opt5 from hemagglutinin__InfluenzaA__ABV30657
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagguuuuucucuaugcgcaggccucuggacgcaucacaguguccaccaaaagaagccaacagacagucauuccgaacaucggcucccggccccgcgugagaaauauuccuucucggaucagcaucuacuggaccauugugaagcccggggauauccugcugauuaacuccaccggaaaucucaucgcuccucgcggcuacuucaaaauuagaagcgggaagucuuccaucaugcggagcgacgcccccaucggaaaguguaacucugaaugcauuacaccgaauggcagcaucccuaacgacaaacccuuucagaaugucaaccgcauuacguauggcgcuuguccuagauacguuaagcagaauacccugaaacuugccacagggaugcggaacgugcccgagaagcaaacccgcggaaucuucggcgcgauugccggguuuaucgaaaauggaugggagggcaugguggaugggugguauggauucagacaccagaacuccgagggcaucggccaggcugccgaccugaaaucuacacaagcugccauugaucagaucaaugggaagcucaaccggcugauuggaaaaaccaacgaaaaguuccaccagaucgagaaggaauuuagcgaggucgaaggccgcauucaggaccuugagaaauacguggaggauacgaagaucgaccugugguccuauaaugccgaacuccugguugcucuggagaaccaacauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcgucgaacucaaauccggauacaaggauuggauucuguggaucagcuuugccauuucuugcuuccuucuguguguggcccuccugggcuuuaucaugugggcuugccagaaagggaacauccgguguaauauuugcaucuga

SEQ ID NO: 185012 - RNA, 1701 nt, Artificial Sequence; identical to SEQ ID NO: 185011
  derived and/or modified sequence opt5 from hemagglutinin__InfluenzaA__ABV45860

SEQ ID NO: 185013 - RNA, 1698 nt, Artificial Sequence; identical to SEQ ID NO: 184979
  derived and/or modified sequence opt5 from hemagglutinin__InfluenzaA__ABV45871

SEQ ID NO: 185014 - RNA, 1698 nt, Artificial Sequence; identical to SEQ ID NO: 184938
  derived and/or modified sequence opt5 from hemagglutinin__InfluenzaA__ABV45882

SEQ ID NO: 185015 - RNA, 1698 nt, Artificial Sequence; identical to SEQ ID NO: 184945
  derived and/or modified sequence opt5 from hemagglutinin__InfluenzaA__ABV45893

SEQ ID NO: 185016 - RNA, 1701 nt, Artificial Sequence; identical to SEQ ID NO: 184753
  derived and/or modified sequence opt5 from hemagglutinin__InfluenzaA__ABV45904

SEQ ID NO: 185017 - RNA, 1698 nt, Artificial Sequence; identical to SEQ ID NO: 184945
  derived and/or modified sequence opt5 from hemagglutinin__InfluenzaA__ABV45926

SEQ ID NO: 185018 - RNA, 1698 nt, Artificial Sequence
  derived and/or modified sequence opt5 from hemagglutinin__InfluenzaA__ABV45937
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugagaccaacggcaaucucauugcgccuagauucgccuuugcucugucccggggguucggaagcggcaucauuacaucuaacgcccccaugggcgaaugugacgcuaagugccagaccccgcaaggggccaucaauuccagccuuccuuuucagaacgugcaccccgucaccaucggagaguguccuaaauaugugcgcucugcgaagcugagaaugguuacaggccuccggaauauucccagcauccagucccgcgggcuguucggagccauugcuggcuuuaucgaagggggauggacgggcaugguggauggcugguacggguaucaucaccagaacgagcaaggaucuggcuacgccgcugaccagaaaagcacccagaaugccauuaacgggaucacaaauaaggucaacuccgugaucgaaaagaugaauacccaguucacagccguuggaaaagaguucaacaaacuggagagacggauggaaaaucucaacaagaagguggaugacggcuuucuggauauuuggaccuacaacgcugagcuucugguccuccuggaaaaugagcgcacgcuugacuuccacgacagcaacgugaaaaaucuguaugaaaaggucaaaucucaacucaagaacaaugcgaaagagaucgggaacggcugcuuugaguucuaccauaaguguaaugaugaaugcauggaguccgugaagaacggaacauaugacuaccccaaauauagcgaagagucuaagcugaauagagagaaaauugauggcguuaagcuggaauccauggggguguaccagauccucgccauuuauagcaccgucgcuuccucucuggugcuucugguuagccucggagccaucuccuuuuggaugugcucuaacggcagccugcagugucggaucugcauuuga

SEQ ID NO: 185019 - RNA, 1698 nt, Artificial Sequence; identical to SEQ ID NO: 184971
  derived and/or modified sequence opt5 from hemagglutinin__InfluenzaA__ABV45948

SEQ ID NO: 185020 - RNA, 1698 nt, Artificial Sequence; identical to SEQ ID NO: 184938
  derived and/or modified sequence opt5 from hemagglutinin__InfluenzaA__ABV45959

SEQ ID NO: 185021 - RNA, 1701 nt, Artificial Sequence
  derived and/or modified sequence opt5 from hemagglutinin__InfluenzaA__ABV45970
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgaucaugcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaccugaaguuuaaguacccugcccuuaaugucaccaugcccaacaacgagaaauucgacaagcuguauauuuggggcgugcaucacccugggacggauaaugaccagaucuuucucuacgcgcaggccucuggacgcauuacaguuuccaccaaaagaagccaacagacagugaucccgaacauuggcucccggccccgcgucagaaauaucccuucucggaucagcauuuauuggaccaucgugaagcccggggauauucugcugaucaacuccaccggaaaucucauugcuccucgcggcuacuucaaaauccagagcgggaagucuuccaucaugagaagcgacgcccccauuggaaaguguaacucugaaugcaucacaccgaauggcagcauuccuaacgacaaacccuuucagaaugugaaccggaucacguacggcgcuuguccucgcuaugucaagcaaaauacccugaaacuugccacagggaugagaaacguucccgagaagcagacccggggaauuuucggcgcgaucgccggguuuaucgaaaauggaugggagggcaugguggaugggugguacggauuccgccaccagaacuccgagggcauuggccaagcugccgaccugaaaucuacacaggcugccaucgaucagauuaaugggaagcucaacagacugaucggaaaaaccaacgaaaaguuccaucagauugagaaggaauuuagcgagguggaaggccggauccaagaccuugagaaauaugucgaggauacgaagauugaccugugguccuacaaugccgaacuccugguggcucuggagaaccagcacacaaucgaucucaccgacagcgaaaugaauaaacuguucgagaagaccaaaaagcagcuuagagaaaacgcggaggauauggggaauggaugcuuuaagaucuaucauaaaugugacaacgccugcauuggcucuauccgcaaugggacauacgaucacgacguuuaucgggacgaggcucugaacaauagauuccagauuaagggcguggaacucaaauccggauacaaggauuggauccuguggauuagcuuugccaucucuugcuuccuucugugugucgcccuccugggcuuuaucaugugggcuugccaaaaagggaacauucgcuguaauaucugcauuuga

SEQ ID NO: 185022 - RNA, 1701 nt, Artificial Sequence
  derived and/or modified sequence opt5 from hemagglutinin__InfluenzaA__ABV45981
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaagggcguggaacucaaauccggauacaaggauuggaucauuuggaucagcuuugccaucucuugcuuccugcuuugugucgcccugcucggcuuuauuaugugggcuugccagaaagggaacauccgguguaauauuugcaucuga

SEQ ID NO: 185023 - RNA, 1698 nt, Artificial Sequence
  derived and/or modified sequence opt5 from hemagglutinin__InfluenzaA__ABV82551
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcgaauccagcuuuuaccgcaaucugcuuuggcugaccgagaagaacggccucuaucccaaucugucuaaauccuacgcuaacaauaaggaaaaagaggugcugguccucuggggagugcaucacccuccgaacaucggggaucagagagcccuguaccacacagaaaacgcuuaugugagcgucguuuccucucauuacagccggcgcuucacccccgagauugccaagagaccuaaagugcgggaccaggagggccgcaucaauuauuacuggacgcuucuggaacccggggauacaauuaucuuugaggcgaacggaaaucucauugccccuagauucgcuuuugcccugucccggggcuucgggagcggaaucauuaccucuaacgcucccauggacaagugugaugccaagugccagacaccgcaaggcgcgaucaauuccagccuuccuuuucagaacgugcaccccgucaccaucggcgaauguccuaaauaugugcgcucuaccaagcugagaaugguuacagggcuccggaauauucccagcauccagucccgcggacuguucggcgccauugcuggguuuaucgagggaggcuggacggggaugguggacggaugguacggcuaucaucaccagaacgaacaaggcucuggguacgccgcugaucagaaaagcacccagaaugccauuaacggaaucacaaauaaggucaacuccgugaucgagaaaaugaauacccaguucacagccguuggcaaggaguucaacaaacuggaaagacggauggagaaucucaacaagaagguggacgauggguuucuggacauuuggaccuacaacgcugaacuucugguccuccuggagaaugaacgcacgcuugacuuccacgauagcaacgugaaaaaucuguaugagaaggucaaaucucaacucaagaacaaugcgaaagagaucggaaacggcugcuuugaguucuaccauaaguguaaugacgaaugcauggaauccgugaagaacgggacauaugauuaccccaaauauagcgaggagucuaagcugaauagagagaaaauugacggcguuaagcuggaauccaugggaguguaccagauccucgccauuuauagcaccgucgcuuccucucuggugcuucugguuagccucggcgccaucuccuuuuggaugugcucuaacgggagccugcagugucggaucugcauuuga

SEQ ID NO: 185024 - RNA, 1701 nt, Artificial Sequence; identical to SEQ ID NO: 184952
  derived and/or modified sequence opt5 from hemagglutinin__InfluenzaA__ABV82562

SEQ ID NO: 185025 - RNA, 1701 nt, Artificial Sequence; identical to SEQ ID NO: 184952
  derived and/or modified sequence opt5 from hemagglutinin__InfluenzaA__ABW36168

SEQ ID NO: 185026 - RNA, 1698 nt, Artificial Sequence; identical to SEQ ID NO: 184938
  derived and/or modified sequence opt5 from hemagglutinin__InfluenzaA__ABW36179

SEQ ID NO: 185027 - RNA, 1698 nt, Artificial Sequence; identical to SEQ ID NO: 184981
  derived and/or modified sequence opt5 from hemagglutinin__InfluenzaA__ABW36190

SEQ ID NO: 185028 - RNA, 1698 nt, Artificial Sequence; identical to SEQ ID NO: 184938
  derived and/or modified sequence opt5 from hemagglutinin__InfluenzaA__ABW36201

SEQ ID NO: 185029 - RNA, 1698 nt, Artificial Sequence
  derived and/or modified sequence opt5 from hemagglutinin__InfluenzaA__ABW36212
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagaauagcuggccuaaccauaccgugacaggaguuucugccuccugcagccacaauggcaagucuuccuuuuaccgcaaccugcuuuggcugaccggcaaaaaugggcucuaucccaaccugagcaagucuuacgcuaauaacaaagaaaaggaggugcugguccucuggggagugcaucacccuccgaacaucggcgaucagagagcccuguaccacacagaaaaugcuuauguguccgucguuagcucccauuacucucggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccgggggcuuggauccggcaucauuaccagcaaugcucccauggacgaaugugaugccaagugccagacaccgcaaggcgcgaucaacucuucccugccuuuccagaaugugcaccccgucaccaucggggaguguccuaaauaugugcgcagcgccaagcucagaaugguuaccggacugcggaacauucccucuauccagagccgcggccuguuuggggcuauugccggauucaucgaaggcggguggacaggaaugguggacggcugguacggcuaucaucaccagaaugagcaaggguccggauacgcugccgaucagaaaucuacgcagaacgccauuaauggcaucaccaacaaggucaauagcgugaucgaaaagaugaacacacaguuuaccgcuguugggaaagaguucaauaaacucgagagacggauggaaaaccugaacaagaagguggacgauggauuccuugacauuuggacauacaaugcggagcugcucguccugcuugaaaacgagcgcacccuggacuuucacgauuccaaugugaaaaaccucuaugaaaaggucaaaggccaacugaagaauaacgccaaagagaucgggaauggcugcuucgaguuuuaccauaaguguaacgacgaaugcauggagagcgugaagaauggaacguaugauuaccccaaauauucugaagaguccaagcugaacagagagaaaauugacggcguuaagcucgaaagcauggggguguaccagauccuggcuauuuauucuacagucgccuccagccuugugcugcucguuucccugggagccaucucuuucuggaugugcagcaauggcucccugcagugucggaucugcauuuga

SEQ ID NO: 185030 - RNA, 1698 nt, Artificial Sequence; identical to SEQ ID NO: 184934
  derived and/or modified sequence opt5 from hemagglutinin__InfluenzaA__ABW36223

SEQ ID NO: 185031 - RNA, 1698 nt, Artificial Sequence; identical to SEQ ID NO: 184934
  derived and/or modified sequence opt5 from hemagglutinin__InfluenzaA__ABW36245

SEQ ID NO: 185032 - RNA, 1698 nt, Artificial Sequence; identical to SEQ ID NO: 184934
  derived and/or modified sequence opt5 from hemagglutinin__InfluenzaA__ABW36267

SEQ ID NO: 185033 - RNA, 1698 nt, Artificial Sequence; identical to SEQ ID NO: 184938
  derived and/or modified sequence opt5 from hemagglutinin__InfluenzaA__ABW36278

SEQ ID NO: 185034 - RNA, 1698 nt, Artificial Sequence
  derived and/or modified sequence opt5 from hemagglutinin__InfluenzaA__ABW36289
augaagcugaaacuccuggugcuucugugcaccuucacagccacguacgcugacaccaucuguauuggcuaucacgccaacaauagcacagauaccgucgacacaguucucgagaagaacgugaccgugacacauuccgucaaucugcuugaagauucucacaacgggaaacugugccuccugaagggaaucgcgccccugcagcucggcaauuguagcguggcuggguggauucugggaaacccugagugcgaacuucugaucuccaaagagucuuggagcuacauuguugaaaccccgaaucccgagaacggcacguguuauccuggguacuuugccgacuaugaggaacucagagagcaacuguccucugugagcuccuucgaacgguuugagaucuuccccaaggagagcucuuggccuaaucauaccgucacaggaguguccgccagcugcucucacaacggcaaguccagcuuuuaccgcaaucuucuguggcucaccggcaaaaacgggcuguaucccaaucugucuaaguccuacgcuaacaauaaagaaaaggagguucucgugcuguggggaguccaucacccuccgaacaucggcgaucagagagcccuuuaccacacagaaaacgcuuaugugagcguggucuccucucauuacagccggcgcuucacccccgagauugccaaaagaccuaagguucgggaccaggaagggcgcaucaauuauuacuggacgcugcucgagcccggagauacaauuaucuuugaggcgaacggcaaucugauugccccuagauucgcuuuugcccuuucccggggguucggaagcggcaucauuaccucuaacgcucccauggacgaaugugaugccaagugccagacaccgcaaggcgcgaucaauuccagccugccuuuucagaacgugcaccccgugaccaucggggaguguccuaaauauguccgcucuaccaagcucagaauggugacaggacugcggaauauucccagcauccagucccgcggccuguucggggccauugcuggauuuaucgaaggcggguggacgggaaugguugacggcugguacggcuaucaucaccagaacgagcaagggucuggauacgccgcugaucagaaaagcacccagaaugccauuaacggcaucacaaauaaggugaacuccgucaucgaaaagaugaauacccaguucacagccguggggaaagaguucaacaaacucgagagacggauggaaaaucugaacaagaagguugacgauggauuucuugacauuuggaccuacaacgcugagcugcucgugcugcuugaaaaugagcgcacgcuggacuuccacgauagcaacgucaaaaaucucuaugaaaaggugaaaucucaacugaagaacaaugcgaaagagaucggcaacgggugcuuugaguucuaccauaaguguaaugacgaaugcauggaguccgucaagaacggcacauaugauuaccccaaauauagcgaagagucuaagcugaauagagagaaaauugacggagugaagcucgaauccaugggcguuuaccagauccuggccauuuauagcaccguggcuuccucucuuguccugcucgugagccugggggccaucuccuuuuggaugugcucuaacggaagccugcagugucggaucugcauuuga

SEQ ID NO: 185035 - RNA, 1698 nt, Artificial Sequence; identical to SEQ ID NO: 184945
  derived and/or modified sequence opt5 from hemagglutinin__InfluenzaA__ABW36300

SEQ ID NO: 185036 - RNA, 1701 nt, Artificial Sequence
  derived and/or modified sequence opt5 from hemagglutinin__InfluenzaA__ABW36311
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcuucuugcucccacaaaggcaagagcucuuuuuaucgcaaucuccuguggcuuaccgagaaaaacggcuccuacccuaaucugagcaaguccuaugucaacaauaaggaaaaagaggugcucguucuguggggagugcaucaccccucuaacaucgaagaccagaagacaauuuacagaaaagagaaugccuacgucagcgugguguccagcaacuauaaccggcgcuucaccccugaaaucgcgaagagaccgaaaguccgggaucaggaggggcgcauuaauuacuauuggacacugcucgagcccggcgacaccaucauuuuugaagccaacgggaaucugaucgcuccuugguacgccuucgcucuuucuagaggauuuggcuccgggauuaucacgagcaacgccucuauggaugagugugacacaaagugccagacaccccaaggagcgaucaauagcucccugccuuuccagaacguucaccccgugaccauuggcgaauguccgaaauaugugcggucuaccaagcuccgcauggucaccggccugagaaauaucccuagcauucagucccgggggcuuuuuggagccaucgcuggcuucauugaagggggauggacaggcaugaucgaugggugguacggauaucaucaccagaacgaacaaggcagcggcuacgccgcugaccagaagucuacgcagaaugccaucaacgggauuaccaauaaagugaacuccguuaucgagaagaugaauacacaguuuaccgccgugggaaaagaguucaacaagcuggaaaaacgcauggagaaucucaacaagaaggucgaugacggcuuccuggacauuuggacauacaacgcugaacugcucgugcugcuugagaaugaaagaacccuggauagccaugacucuaacguuaaaaaucucuaugagaaggugaaaucccaacugaagaacaaugcgaaagagaucgggaacggaugcuuugaguucuaccacaaguguaauaacgagugcauggaaagcgucaagaauggcacguaugauuaccccaaauauuccgaggagucuaaacuuaaccgggaaaagauugacggggugaagcuggagagcaugggcgucuaccagauccucgccaucuauuccacaguggcuucuagccugguucugcucgugucccugggagccauuagcuuuuggaugugcucuaauggcucccuucaguguagaaucugcauuuga

SEQ ID NO: 185037 - RNA, 1701 nt, Artificial Sequence
  derived and/or modified sequence opt5 from hemagglutinin__InfluenzaA__ABW38363
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggcgugcaccauccugggacggauaaugaccagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggauauccugcugauuaacuccaccggaaaucucaucgcuccucgcggcuacuucaagauuagaagcgggaagucuuccaucaugcggagcgacgcccccaucggaaaauguaacucugaaugcauuacaccgaauggcagcaucccuaacgacaagcccuuucagaaugugaaccgcauuacguauggcgcuuguccuagauacgucaaacagaauacccugaaacuugccacagggaugcggaacguucccgagaagcaaacccgcggaaucuucggcgcgauugccggguuuaucgaaaauggaugggagggcaugguggaugggugguauggauucagacaccagaacuccgagggcaucggccaggcugccgaccugaagucuacacaagcugccauugaucagaucaaugggaaacucaaccggcugauuggaaagaccaacgaaaaguuccaccagaucgagaaagaauuuagcgagguggaaggccgcauucaggaccuugagaaguacgucgaggauacgaaaaucgaccugugguccuauaaugccgaacucauuguggcucuggagaaccaacauacaaucgaucugaccgacagcgaaaugaauaaacucuucgagagaaccaagaagcagcugcgggaaaacgcggaggauauggggaauggaugcuuuaagaucuaccacaaaugugacaacgccugcauuggcucuaucagaaaugggacauaugaucaugacguuuaccgcgacgaggcucuuaacaaucgguuccagauuaagggcguggaacugaaauccggauacaaggauuggauccucuggauuagcuuugccaucucuugcuuccugcuuugugucgcccugcucggcuuuaucaugugggcuugccagaaagggaacauuagauguaauaucugcauuuga

SEQ ID NO: 185038 - RNA, 1698 nt, Artificial Sequence
  derived and/or modified sequence opt5 from hemagglutinin__InfluenzaA__ABW39777
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagaauagcuggccuaaccauaccgugacaggaguuucugccuccugcagccacaauggcaagucuuccuuuuaccgcaaccugcuuuggcugaccggcaaaaaugggcucuaucccaaccugagcaagucuuacgcuaauaacaaagaaaaggaggugcugguccucuggggagugcaucacccuccgaacaucggcgaucagagagcccuguaccacacagaaaaugcuuauguguccgucguuagcucccauuacucucggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccgggggcuuggauccggcaucauuaccagcaaugcucccauggacgaaugugaugccaagugccagacaccgcaaggcgcgaucaacucuucccugccuuuccagaaugugcaccccgucaccaucggggaguguccuaaauaugugcgcagcgccaagcucagaaugguuaccggacugcggaacauucccucuauccagagccgcggccuguuuggggcuauugccggauucaucgaaggcggguggacaggaaugguggacggcugguacggcuaucaucaccagaaugagcaaggguccggauacgcugccgaucagaaaucuacgcagaacgccauuaauggcaucaccaacaaggucaauagcgugaucgaaaagaugaacacacaguuuaccgcuguugggaaagaguucaauaaacucgagagacggauggaaaaccugaacaagaagguggacgauggauuccuugacauuuggacauacaaugcggagcugcucguccugcuugaaaacgagcgcacccuggacuuucacgauuccaaugugaaaaaccucuaugaaaaggucaaaagccaacugaagaauaacgccaaagagaucggcaaugggugcuucgaguuuuaccauaaguguaacgacgaaugcauggagucugugaagaauggcacguaugauuaccccaaauauuccgaagagagcaagcugaacagagagaaaauugacggaguuaagcucgaaucuaugggcguguaccagauccuggcuauuuauuccacagucgccagcucccuugugcugcucguuucucugggggccaucagcuucuggaugugcuccaauggaucucugcagugucggaucugcauuuga

SEQ ID NO: 185039 - RNA, 1698 nt, Artificial Sequence; identical to SEQ ID NO: 184938
  derived and/or modified sequence opt5 from hemagglutinin__InfluenzaA__ABW39806

SEQ ID NO: 185040 - RNA, 1698 nt, Artificial Sequence; identical to SEQ ID NO: 184945
  derived and/or modified sequence opt5 from hemagglutinin__InfluenzaA__ABW39817

SEQ ID NO: 185041 - RNA, 1698 nt, Artificial Sequence
  derived and/or modified sequence opt5 from hemagglutinin__InfluenzaA__ABW39828
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaucgcgccccugcagcugggcaacuguucuguugcuggguggauucucggaaauccugagugcgaacugcuuaucagcaaagaguccuggucuuacauuguggaaaagccgaaccccgagaauggcaccuguuauccugggcauuuugccgacuacgaggaacugagagagcaacucagcuccgucucuagcuucgaacgguuugagaucuuccccaaggaguccagcuggccuaaccacacggugaccggaguuucugccuccugcagccauaauggcgaaucuuccuuuuauaaaaaccugcuuuggcugacaggcaagaaugggcucuaccccaaccugagcaaaucuuaugcuaauaacaaggagaaagaagugcugguccucuggggagugcaccacccuccgaacaucggcgaucagaugacccuguaccauaaggagaaugccuacguguccgucguuagcucccacuauucucgcaaguucacacccgaaauugcuaaaagaccuaaggugcgggaccaggaggggcgcaucaacuacuauuggacccuucuggagcccggagauacgauuaucuuugaagccaauggcaaccucauugcgccuagauacgccuucgcucugagccggggguuuggauccggcaucauuaauagcaacgcccccauggacgagugugaugcuaaaugccagacaccgcaaggcgccaucaauucuucccuuccuuuccagaacgugcaucccgucaccaucggggaauguccuaaguaugugcgcagcgcgaaacugagaaugguuacaggacuccggaauauucccucuauccagagccgcggccuguuuggggccauugcuggauucaucgagggcggguggaccggaaugguggacggcugguacggcuaucaccaccagaacgaacaaggguccggauacgccgcugaucagaagucuacccagaaugccauuaacggcaucacaaauaaagucaacagcgugaucgagaagaugaauacgcaguuuaccgccguugggaaggaguucaacaaacuggaaagacggauggagaaccucaauaagaaaguggacgauggauucauugacgucuggacauacaacgcugaacugcuugugcugcucgagaaugaacgcacccuggacuuucaugauuccaacgucaagaaucuuuaugagaaagugaagaaccaacugaagaauaacgcgaaagagaucggcaaugggugcuucgaauuuuaccacaaguguaacgacgagugcauggaaagcguuaaaaauggcacauaugauuaccccaaguauucugaggaguccaaacucagcagagaaaagauugacggagugaagcuggagucuaugggcgucuaccagauccuggccauuuauuccaccguggcuagcucccucguucugcuugugucucugggggccaucagcuucuggaugugcuccaacggaucucuccagugucggaucugcauuuga

SEQ ID NO: 185042 - RNA, 1698 nt, Artificial Sequence
  derived and/or modified sequence opt5 from hemagglutinin__InfluenzaA__ABW39839
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacagcaacaauaaagaaaaggaggugcugguccucuggggagugcaucacccuccgaacaucggcgaucagagagcucuguaccacacagaaaacgccuauguguccgucguuucuagccauuacucccggcgcuucacccccgagauugcuaaaagaccuaaggugcgggaccaggaagggcgcaucaauuauuacuggacgcuucuggagcccggagauacaauuaucuuugaggccaacggcaaucucauugcgccuagauucgccuuugcucugagccggggguucggaucuggcaucauuaccuccaacgcccccaugggcgaaugugacgcuaagugccagacaccgcaaggggccaucaauagcucucuuccuuuucagaacgugcaccccgucaccaucggagaguguccuaaauaugugcgcagcgcgaagcugagaaugguuaccggccuccggaauauucccuccauccagucucgcgggcuguucggagccauugcuggcuuuaucgaagggggauggacaggcaugguggauggcugguacggguaucaucaccagaacgagcaaggaagcggcuacgccgcugaccagaaauccacgcagaaugccauuaacgggaucaccaauaaggucaacagcgugaucgaaaagaugaauacacaguucaccgccguuggaaaagaguucaacaaacuggagagacggauggaaaaucucaacaagaagguggaugacggcuuucuggauauuuggacauacaacgcugagcuucugguccuccuggaaaaugagcgcacccuugacuuccacgacucuaacgugaaaaaucuguaugaaaaggucaaaucccaacucaagaacaaugcgaaagagaucgggaacggcugcuuugaguucuaccauaaguguaaugaugaaugcauggagagcgugagaaacggaacguaugacuaccccaaguauucugaagaguccaaacugaaucgggagaagauugauggcguuaaacuggaaagcauggggguguaccagauccucgccauuuauuccacagucgcuucuagccuggugcuucugguuucccucggagccaucucuuuuuggaugugcagcaacggcucccugcaguguagaaucugcauuuga

SEQ ID NO: 185043 - RNA, 1698 nt, Artificial Sequence
  derived and/or modified sequence opt5 from hemagglutinin__InfluenzaA__ABW39850
augaaggugaaacugcucguccugcuuugcaccuucacagccacgaacgcugacaccaucuguauuggcuaccacgccaauaacagcacagauaccguugacacagugcuggagaagaaugugaccgucacacauuccgugaaccuccuggaaaauucucacaacgggaaacuuugccugcucaagggaaucgcgccccugcagcugggcaauuguagcguugcuggguggauucucggaaacccugagugcgaacugcuuaucuccaaagagucuuggagcuauauuguggaaaagccgaaucccgagaacggcaccuguuacccugggcauuuugccgauuaugaggaacugagagagcaacucuccucugucagcuccuucgaacgguuugagaucuuccccaaggagagcucuuggccuaaucacacggugaccggaguuuccgccagcugcucucauaacggcgaauccagcuuuuaccgcaaucugcuuuggcugacaggcaaaaacgggcucuaucccaaucugucuaaguccuacgcuaacaacaaagagaaggaagugcugguccucuggggagugcaccacccuccgaauaucggcgaccagaaagcccuguaucauaccgagaacgcuuacgugagcgucguuuccucucacuacagcagaaaguucacacccgaaauugccaagcggccuaaagugcgcgaucaggaggggagaaucaauuauuacuggacccuucuggagcccggagacacgauuaucuuugaagcgaacggcaaucucauugccccucgguaugcuuucgcccugucccgcggguuuggaagcggcaucauuaacucuaaugcucccauggauaagugugacgccaaaugccagacaccgcaaggcgcgaucaacuccagccuuccuuuccagaaugugcaucccgucaccaucggggaguguccuaaguacgugagaucugccaaacugcggaugguuacaggacuccgcaacauucccagcauccaguccagaggccuguuuggggcuauugccggauucaucgaaggcggguggaccggaaugguggauggcugguauggcuaccaccaccagaaugagcaagggucuggauaugcugccgaccaaaagagcacccagaacgccauuaauggcaucacaaacaaagucaauuccgugaucgaaaagaugaacacgcaguuuaccgcuguugggaaggaguucaacaaacuggagcggcgcauggaaaaucucaacaagaaaguggaugacggauucauugauaucuggacauacaaugcggagcugcuuguccugcucgaaaacgagagaacccuggacuuucaugacagcaaugugaagaaccuuuacgaaaaagucaagggccagcugaagaauaacgccaaagagauugggaauggcugcuucgaguuuuaucacaaguguaacgaugaaugcauggagucugugaaaaauggaacauacgacuaucccaaguacuccgaagagagcaaacucaaccgggagaagaucgauggcguuaagcuggaaucuauggggguguaucagauucuggcuaucuacuccaccgucgccagcucccucgugcugcuuguuucucugggagccaucagcuucuggaugugcuccaauggcucucuccagugucgcauuugcaucuga

SEQ ID NO: 185044 - RNA, 1698 nt, Artificial Sequence; identical to SEQ ID NO: 184969
  derived and/or modified sequence opt5 from hemagglutinin__InfluenzaA__ABW39861

SEQ ID NO: 185045 - RNA, 1701 nt, Artificial Sequence; identical to SEQ ID NO: 184952
  derived and/or modified sequence opt5 from hemagglutinin__InfluenzaA__ABW39872

SEQ ID NO: 185046 - RNA, 1698 nt, Artificial Sequence
  derived and/or modified sequence opt5 from hemagglutinin__InfluenzaA__ABW39883
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccucacaacaucggcgaucagagagcccuguaccauacagaaaacgcuuaugugagcgucguuuccucucacuacagccggcgcuucaccccggagauugccaaaagacccaaggugcgggaccaggaagggcgcaucaauuauuacuggacgcuucuggagccuggagauacaauuaucuuugaggcgaacggcaaucucauugcccccagauucgcuuuugcccugucccggggguucggaagcggcaucauuaccucuaacgcuccuauggacgaaugugaugccaagugccagacaccccaaggcgcgaucaauuccagccuuccguuucagaacgugcauccugucaccaucggggagugucccaaauaugugcgcucuaccaagcugagaaugguuacaggacuccggaauauuccuagcauccagucccgcggccuguucggggccauugcuggauuuaucgaaggcggguggacgggaaugguggacggcugguacggcuaucaccaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccaugauagcaacgugaaaaaucuguaugaaaaggucaaaucucaacucaagaacaaugcgaaagagaucggcaacgggugcuuugaguucuaccacaaguguaaugacgaaugcauggaguccgugaagaacggcacauaugauuaccccaaauauagcgaagagucuaagcugaauagagagaaaauugacggaguuaagcuggaauccaugggcguguaccagauccucgccauuuauagcaccgucgcuuccucucuggugcuucugguuagccucggggccaucuccuuuuggaugugcucuaacggaagccugcagugucggaucugcauuuga

SEQ ID NO: 185047 - RNA, 1698 nt, Artificial Sequence; identical to SEQ ID NO: 184979
  derived and/or modified sequence opt5 from hemagglutinin__InfluenzaA__ABW39894

SEQ ID NO: 185048 - RNA, 1698 nt, Artificial Sequence; identical to SEQ ID NO: 184934
  derived and/or modified sequence opt5 from hemagglutinin__InfluenzaA__ABW39905

SEQ ID NO: 185049 - RNA, 1698 nt, Artificial Sequence; identical to SEQ ID NO: 184938
  derived and/or modified sequence opt5 from hemagglutinin__InfluenzaA__ABW39927

SEQ ID NO: 185050 - RNA, 1701 nt, Artificial Sequence
  derived and/or modified sequence opt5 from hemagglutinin__InfluenzaA__ABW39938
augaagaccaucauugcccugagcuacauccucugccugguguucgcucagaaaauucccggcaacgacaauuccacagccacgcuuugucuggggcaccaugcggucccuaacggaaccaucguuaagacaauuaccaaugaucaaaucgaggugacaaacgcuaccgaacucgugcagucuagcuccacaggcgagaucugcgacucuccgcaccagauucuggauggggaaaauuguacccuuaucgacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauucgcagaucuaacaauuccuuuuucagccggcuuaacuggcugacacaucucaaguuuaaguauccugcccugaaugucaccaugcccaacaacgagaaauucgacaaacuuuacaucuggggcgugcaccauccugggacggauaaugaccagauuuuucuguaugcgcaggccucuggacgcaucacaguuuccaccaagagaagccaacagacagugauuccgaacaucggcucccggccccgcgucagaaauaucccuucucggauuagcaucuacuggaccauugugaagcccggggauauccuccugauuaacuccaccggaaaucugaucgcuccucgcggcuacuucaaaaucagaagcgggaagucuuccauuaugcggagcgacgcccccaucggaaaguguaacucugaaugcauuacaccgaauggcagcaucccuaacgacaaacccuuucagaaugugaaccgcauuacguauggcgcuuguccuagauacgucaagcagaauacccucaaacuggccacagggaugcggaacguucccgagaagcaaacccgcggaaucuucggcgcgaucgccggguuuauugaaaauggaugggagggcaugguggaugggugguauggauucagacaccagaacuccgagggcaucggccaggcugccgaccuuaaaucuacacaagcugccauugaucagaucaaugggaagcugaaccggcucauuggaaaaaccaacgaaaaguuccaccagaucgagaaggaauuuagcgagguggaaggccgcauucaggaccuggagaaauacgucgaggauacgaagaucgaccuuugguccuauaaugccgaacugcucguggcucuggagaaccaacauacaaucgaucugaccgacagcgaaaugaauaaacucuucgagaagaccaaaaagcagcugagagaaaacgcggaggauauggggaauggaugcuuuaagauuuaccacaaaugugacaacgccugcaucggcucuauucggaaugggacauaugaucaugacgcuuacagagacgaggcccuuaacaaucgcuuccagaucaagggcguugaacugaaauccggauacaaggauuggauucucuggaucagcuuugccaucucuugcuuccugcuuuguguggcucugcucggcuuuauuaugugggccugccagaaagggaacauccgguguaauauuugcaucuga

SEQ ID NO: 185051 - RNA, 1698 nt, Artificial Sequence; identical to SEQ ID NO: 184938
  derived and/or modified sequence opt5 from hemagglutinin__InfluenzaA__ABW39949

SEQ ID NO: 185052 - RNA, 1698 nt, Artificial Sequence; identical to SEQ ID NO: 184979
  derived and/or modified sequence opt5 from hemagglutinin__InfluenzaA__ABW39960

SEQ ID NO: 185053 - RNA, 1698 nt, Artificial Sequence; identical to SEQ ID NO: 184934
  derived and/or modified sequence opt5 from hemagglutinin__InfluenzaA__ABW39982

SEQ ID NO: 185054 - RNA, 1698 nt, Artificial Sequence; identical to SEQ ID NO: 184954
  derived and/or modified sequence opt5 from hemagglutinin__InfluenzaA__ABW39993

SEQ ID NO: 185055 - RNA, 1698 nt, Artificial Sequence; identical to SEQ ID NO: 184934
  derived and/or modified sequence opt5 from hemagglutinin__InfluenzaA__ABW40004

SEQ ID NO: 185056 - RNA, 1698 nt, Artificial Sequence; identical to SEQ ID NO: 184980
  derived and/or modified sequence opt5 from hemagglutinin__InfluenzaA__ABW40015

SEQ ID NO: 185057 - RNA, 1701 nt, Artificial Sequence; identical to SEQ ID NO: 185011
  derived and/or modified sequence opt5 from hemagglutinin__InfluenzaA__ABW40026

SEQ ID NO: 185058 - RNA, 1698 nt, Artificial Sequence; identical to SEQ ID NO: 184934
  derived and/or modified sequence opt5 from hemagglutinin__InfluenzaA__ABW40037

SEQ ID NO: 185059 - RNA, 1698 nt, Artificial Sequence
  derived and/or modified sequence opt5 from hemagglutinin__InfluenzaA__ABW40048
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagaaagcccuguaccacacagaaaacgcuuaugugagcgucguuuccucucauuacagcagacgguucacccccgagauugccaagcgcccuaaggugagagaccaggaagggcggaucaauuauuacuggacgcuucuggagcccggagauacaauuaucuuugaggcgaacggcaaucucauugccccucgcuucgcuuuugcccuguccagaggguucggaagcggcaucauuaccucuaacgcucccauggacgaaugugaugccaaaugccagacaccgcaaggcgcgaucaauuccagccuuccuuuucagaacgugcaccccgucaccaucggggaguguccuaaguaugugcggucuaccaaacugcgcaugguuacaggacucagaaauauucccagcauccagucccggggccuguucggggccauugcuggauuuaucgaaggcggguggacgggaaugguggacggcugguacggcuaucaucaccagaacgagaaggggucuggauacgccgcugaucagaaaagcacccaaaaugccauuaacggcaucacaaauaaggucaacuccgugaucgaaaagaugaauacccaguucacagccguugggaaagaguucaacaagcuggagcgcagaauggaaaaucucaacaaaaagguggacgauggauuucuggacauuuggaccuacaacgcugagcuucugguccuccuggaaaaugagcggacgcuugacuuccacgauagcaacgugaaaaaucuguaugaaaaggucaaaucucagcucaagaacaaugcgaaggagaucggcaacgggugcuuugaguucuaccauaaauguaaugacgaaugcauggaguccgugaagaacggcacauaugauuaccccaaauauagcgaagagucuaagcugaaucgcgagaaaauugacggaguuaagcuggaauccaugggcguguaccaaauccucgccauuuauagcaccgucgcuuccucucuggugcuucugguuagccucggggccaucuccuuuuggaugugcucuaacggaagccugcaguguagaaucugcauuuga

SEQ ID NO: 185060 - RNA, 1698 nt, Artificial Sequence; identical to SEQ ID NO: 184938
  derived and/or modified sequence opt5 from hemagglutinin__InfluenzaA__ABW40059

SEQ ID NO: 185061 - RNA, 1698 nt, Artificial Sequence
  derived and/or modified sequence opt5 from hemagglutinin__InfluenzaA__ABW40070
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucaagcgguuugaaaucuuccccaaagagagcucuuggccuaaccacacggugaccggaguuuccgccagcugcucucauaauggcgaguccagcuuuuaucgcaaccugcuuuggcugacaggcaagaaugggcucuaccccaaccugucuaaauccuaugcuaauaacaaggaaaaagaggugcugguccucuggggagugcaccacccuccgaacaucggcgaccagaaggcccuguaccauaccgaaaaugcuuacgugagcgucguuuccucucacuauagcagaaaguucacacccgagauugccaaacggccuaaggugcgcgaucaggaagggagaaucaacuacuauuggacccuucuggagcccggagacacgauuaucuuugaggcgaauggcaaccucauugccccucgguacgcuuucgcccugucccgcggguuuggaagcggcaucauuaauucuaacgcucccauggauaaaugugacuccaagugccagacaccgcaaggcgccaucaauagcucucuuccuuuccagaacgugcaucccgucaccaucggggaauguccuaaauaugugagaagcgcgaagcugcggaugguuacaggacuccgcaauauucccuccauccagucuagaggccuguuuggggccauugcuggauucaucgagggcggguggaccggaaugguggauggcugguacggcuaucaccaccagaacgaacaagggagcggauacgccgcugaccagaaauccacccagaaugccauuaacggcaucacaaauaaggucaacagcgugaucgagaagaugaauacgcaguuuaccgccguugggaaagaguucaacaagcuggaacggcgcauggagaaccucaauaaaaagguggaugacggauucauugauaucuggacauacaacgcugaacugcuuguccugcucgagaaugaaagaacccuggacuuucaugacucuaacgugaaaaaucuuuaugagaaggucaagucccaacugaaaaacaaugcgaaggaaauuggcaacgggugcuucgaguuuuaccacaaauguaaugaugagugcauggaaagcgugaagaacggcacauaugacuaccccaaauauucugaggaauccaagcucaaucgggagaagaucgauggaguuaaacuggagagcaugggcguguaccagauucuggccaucuauuccaccgucgcuucuagccucgugcugcuuguuucccugggggccaucucuuucuggaugugcagcaacggaucccuccagugucgcauuugcaucuga

SEQ ID NO: 185062 - RNA, 1701 nt, Artificial Sequence; identical to SEQ ID NO: 184952
  derived and/or modified sequence opt5 from hemagglutinin__InfluenzaA__ABW40081

SEQ ID NO: 185063 - RNA, 1698 nt, Artificial Sequence
  derived and/or modified sequence opt5 from hemagglutinin__InfluenzaA__ABW40092
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucaagcgguuugaaaucuuccccaaggagagcucuuggccuaaucauaccgucacaggaguguccgccagcugcucucacaacggcaaauccagcuuuuaccgcaaucugcuuuggcugaccggcaagaacgggcucuaucccaaucugucuaaauccuacgcuaacaauaaggagaaagaaguucuggugcucuggggaguccaucacccuccgaacauuggcgaucagagagcccuguaccacacagagaacgcuuaugugagcguggucuccucucauuacagccggcgcuucacccccgaaaucgccaagagaccuaagguucgggaccaggaggggcgcauuaauuauuacuggacgcuucuggaacccggagauacaaucauuuuugaggcgaacggcaaucucaucgccccuagauucgcuuuugcccugucccggggguucggaagcggcauuaucaccucuaacgcucccauggacgagugugaugccaaaugccagacaccgcaaggcgcgaucaauuccagccuuccuuuucagaacgugcaccccgugaccauuggggaauguccuaaguauguccgcucuaccaaacugagaauggugacaggacuccggaauauccccagcauucagucccgcggccuguucggggccaucgcuggauuuauugagggcggguggacgggaaugguugacggcugguacggcuaucaucaccagaacgaacaagggucuggauacgccgcugaucaaaagagcacccagaaugccaucaacggcaucacaaauaaagugaacuccgucauugagaagaugaauacccaguucacagccguggggaaagaguucaacaagcuggaaagacggauggagaaucucaacaagaaaguugacgauggauuucuggacaucuggaccuacaacgcugaacuucuggugcuccuggagaaugaacgcacgcuugacuuccacgauagcaacgucaagaaucuguaugagaaagugaagucucagcucaaaaacaaugcgaaggaaauuggcaacgggugcuuugaguucuaccauaaguguaaugacgagugcauggaauccgucaaaaacggcacauaugauuaccccaaguauagcgaggaaucuaaacugaauagagagaagaucgacggagugaaacuggaguccaugggcguuuaccagauucucgccaucuauagcaccguggcuuccucucugguccuucuggugagccucggggccaucuccuuuuggaugugcucuaacggaagccugcagugucggauuugcaucuga

SEQ ID NO: 185064 - RNA, 1698 nt, Artificial Sequence; identical to SEQ ID NO: 184981
  derived and/or modified sequence opt5 from hemagglutinin__InfluenzaA__ABW40103

SEQ ID NO: 185065 - RNA, 1698 nt, Artificial Sequence
  derived and/or modified sequence opt5 from hemagglutinin__InfluenzaA__ABW40114
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccaccagcugcucucacaacggcaaguccagcuuuuaccgcaaucugcuuuggcugacaggcaaaaacgggcucuaucccaaucugucuaaguccuacgccaacaauaaagaaaaggagguucuggugcucuggggaguccaucacccuccgaacauuggcaaccagagagcucuguaccacaccgaaaaugccuaugugagcguggucuccucucauuacagccggcgcuucacgcccgagaucgcuaaaagaccuaagguucgggaucaggaagggcgcauuaacuauuacuggacacuucuggagcccggagacaccaucauuuuugaggccaauggcaaccucaucgcgccuagauucgccuuugcucugucccggggguucggaagcggcauuaucacaucuaaugcccccauggaugaaugugacgcuaagugccagaccccgcaaggcgccaucaacuccagccuuccuuuucagaaugugcaccccgugaccauuggggaguguccuaaauauguccgcucuacaaagcugagaauggugacgggacuccggaacauccccagcauucagucccgcggccuguucggggcgaucgccggauuuauugaaggcggguggaccggaaugguugauggcugguacggcuaucaucaccagaaugagcaagggucuggauacgcugccgaccagaaaagcacacagaacgcuaucaauggcaucaccaacaaggucaauuccgugauugaaaagaugaacacacaguucaccgccguggggaaagaguucaauaaacuggagagacggauggaaaaccucaacaagaagguugaugacggauuucuggauaucuggacguacaaugccgagcuucuggugcuccuggaaaacgagcgcacacuugacuuccacgacagcaaugucaaaaaccuguaugaaaaggugaaaucucaacucaagaauaacgcuaaagagauuggcaaugggugcuuugaguucuaccauaaguguaacgaugaaugcauggaguccgucaagaauggcaccuaugacuaccccaaauauagcgaagagucuaagcugaacagagagaaaaucgauggagugaagcuggaauccaugggcguuuaccagauucucgcgaucuauagcaccguggccuccucucugguccuucuggugagccucggggcuaucuccuuuuggaugugcucuaauggaagccugcagugucggauuugcaucuga

SEQ ID NO: 185066 - RNA, 1698 nt, Artificial Sequence; identical to SEQ ID NO: 184934
  derived and/or modified sequence opt5 from hemagglutinin__InfluenzaA__ABW40125

SEQ ID NO: 185067 - RNA, 1701 nt, Artificial Sequence; identical to SEQ ID NO: 184952
  derived and/or modified sequence opt5 from hemagglutinin__InfluenzaA__ABW40136

SEQ ID NO: 185068 - RNA, 1698 nt, Artificial Sequence; identical to SEQ ID NO: 184969
  derived and/or modified sequence opt5 from hemagglutinin__InfluenzaA__ABW40147

SEQ ID NO: 185069 - RNA, 1698 nt, Artificial Sequence; identical to SEQ ID NO: 184938
  derived and/or modified sequence opt5 from hemagglutinin__InfluenzaA__ABW40158

SEQ ID NO: 185070 - RNA, 1698 nt, Artificial Sequence; identical to SEQ ID NO: 184938
  derived and/or modified sequence opt5 from hemagglutinin__InfluenzaA__ABW40180

SEQ ID NO: 185071 - RNA, 1701 nt, Artificial Sequence; identical to SEQ ID NO: 184952
  derived and/or modified sequence opt5 from hemagglutinin__InfluenzaA__ABW40191

SEQ ID NO: 185072 - RNA, 1698 nt, Artificial Sequence; identical to SEQ ID NO: 184954
  derived and/or modified sequence opt5 from hemagglutinin__InfluenzaA__ABW40202

SEQ ID NO: 185073 - RNA, 1698 nt, Artificial Sequence; identical to SEQ ID NO: 184934
  derived and/or modified sequence opt5 from hemagglutinin__InfluenzaA__ABW40213

SEQ ID NO: 185074 - RNA, 1698 nt, Artificial Sequence; identical to SEQ ID NO: 184934
  derived and/or modified sequence opt5 from hemagglutinin__InfluenzaA__ABW40224

SEQ ID NO: 185075 - RNA, 1698 nt, Artificial Sequence; identical to SEQ ID NO: 184938
  derived and/or modified sequence opt5 from hemagglutinin__InfluenzaA__ABW40235

SEQ ID NO: 185076 - RNA, 1701 nt, Artificial Sequence
  derived and/or modified sequence opt5 from hemagglutinin__InfluenzaA__ABW40246
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagguuuuucucuaugcgcaggccucuggacgcaucacaguguccaccaaaagaagccaacagacagucauuccgaacaucggcucccggccccgcgugagaaauauuccuucucggaucagcaucuacuggaccauugugaagcccggggauauccugcugauuaacuccaccggaaaucucaucgcuccucgcggcuacuuccggauuagaagcgggaaaucuuccaucaugcgcagcgacgcccccaucggaaaguguaacucugaaugcauuacaccgaauggcagcaucccuaacgacaagcccuuucagaaugucaacagaauuacguauggcgcuuguccucgguacguuaaacagaauacccugaaacuugccacagggaugcgcaacgugcccgagaagcaaaccagaggaaucuucggcgcgauugccggguuuaucgaaaauggaugggagggcaugguggaugggugguauggauuccggcaccagaacuccgagggcaucggccaggcugccgaccugaagucuacacaagcugccauugaucagaucaaugggaaacucaacagacugauuggaaagaccaacgaaaaauuccaccagaucgagaaggaauuuagcgaggucgaaggccgcauucaggaccuugagaaguacguggaggauacgaaaaucgaccugugguccuauaaugccgaacuccugguugcucuggagaaccaacauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguguaccgcgacgaggcucugaacaaucgguuccagaucaaaggcgucgaacucaaguccggauacaaagauuggauucuguggaucagcuuugccauuucuugcuuccuucuguguguggcccuccugggcuuuaucaugugggcuugccagaaggggaacaucagauguaauauuugcaucuga

SEQ ID NO: 185077 - RNA, 1698 nt, Artificial Sequence
  derived and/or modified sequence opt5 from hemagglutinin__InfluenzaA__ABW40257
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccauuaucgaaaagaugaauacccaguucacagccgucgggaaagaguucaacaaacuggagagacggauggaaaaucucaacaagaagguggacgauggauuucuggacauuuggaccuacaacgcugagcuucugguucuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggagucaagcuggaauccaugggcguguaccagauccucgccaucuauagcaccguugcuuccucucuggugcuucuggucagccucggggccauuuccuuuuggaugugcucuaacggaagccugcagugucggaucugcauuuga

SEQ ID NO: 185078 - RNA, 1701 nt, Artificial Sequence; identical to SEQ ID NO: 185011
  derived and/or modified sequence opt5 from hemagglutinin__InfluenzaA__ABW40268

SEQ ID NO: 185079 - RNA, 1698 nt, Artificial Sequence
  derived and/or modified sequence opt5 from hemagglutinin__InfluenzaA__ABW40312
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggccgcuccagcuuuuacagaaaucugcuuuggcugaccggcaagaacgggcucuaucccaaucugucuaaauccuacgcuaacaauaaggaaaaagaggugcugguccucuggggagugcaucacccuccgaacaucggcgaucagcgggcccuguaccacacagaaaacgcuuaugugagcgucguuuccucucauuacagccgcagauucacccccgagauugccaagcggccuaaagugcgcgaccaggaagggagaaucaauuauuacuggacgcuucuggagcccggagauacaauuaucuuugaggcgaacggcaaucucauugccccucgguucgcuuuugcccugucccgcggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaguaugugagaucuaccaaacugcggaugguuacaggacuccgcaauauucccagcauccaguccagaggccuguucggggccauugcuggauuuaucgaaggcggguggacgggaaugguggacggcugguacggcuaucaucaccagaacgagcaagggucuggauacgccgcugaucaaaagagcacccagaaugccauuaacggcaucacaaauaaagucaacuccgugaucgaaaagaugaauacccaguucacagccguugggaaagaguucaacaagcuggagcggcgcauggaaaaucucaacaaaaagguggacgauggauuucuggacauuuggaccuacaacgcugagcuucugguccuccuggaaaaugagagaacgcuugacuuccacgauagcaacgugaagaaucuguaugaaaaagucaagucucagcucaaaaacaaugcgaaggagaucggcaacgggugcuuugaguucuaccauaaauguaaugacgaaugcauggaguccgugaagaacggcacauaugauuaccccaaguauagcgaagagucuaaacugaaucgggagaagauugacggaguuaaacuggaauccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 185080 - RNA, 1701 nt, Artificial Sequence; identical to SEQ ID NO: 184952
  derived and/or modified sequence opt5 from hemagglutinin__InfluenzaA__ABW40323

SEQ ID NO: 185081 - RNA, 1698 nt, Artificial Sequence; identical to SEQ ID NO: 184980
  derived and/or modified sequence opt5 from hemagglutinin__InfluenzaA__ABW40334

SEQ ID NO: 185082 - RNA, 1698 nt, Artificial Sequence; identical to SEQ ID NO: 184980
  derived and/or modified sequence opt5 from hemagglutinin__InfluenzaA__ABW40345

SEQ ID NO: 185083 - RNA, 1698 nt, Artificial Sequence
  derived and/or modified sequence opt5 from hemagglutinin__InfluenzaA__ABW40356
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcuggucauguggggagugcaucacccuccgaacaucggcgaucagagagcccucuaccacacagaaaacgcuuaugugagcgucguuuccucucauuacagccggcgcuucacccccgagauugccaaaagaccuaaggugcgggaccaggaagggcgcaucaauuauuacuggacgcugcuugagcccggagauacaauuaucuuugaggcgaacggcaaucugauugccccuagauucgcuuuugcccucucccggggguucggaagcggcaucauuaccucuaacgcucccaugggcgaaugugacgccaagugccagacaccgcaaggggcgaucaauuccagccugccuuuucagaacgugcaccccgucaccaucggagaguguccuaaauaugugcgcucugccaaacuuagaaugguuaccggccugcggaauauucccagcauccagucccgcggacucuucggggcuauugccggcuuuaucgaagggggauggacaggcaugguggauggcugguacggguaucaucaccagaacgagcaaggaucuggcuacgcugccgaccagaaaagcacgcagaaugccauuaacgggaucaccaauaaggucaacuccgugaucgaaaagaugaauacacaguucaccgcuguuggaaaggaguucaacaaacuggagagacggauggaaaaucugaacaagaagguggaugacggcuuucucgauauuuggacauacaacgcggagcugcuuguccugcucgaaaaugagcgcacccuggacuuccacgacagcaacgugaaaaaucuuuaugaaaaggucaaaucucaacugaagaacaaugccaaagagaucgggaacggcugcuuugaguucuaccauaaguguaaugaugaaugcauggaguccgugaagaacggaacguaugacuaccccaaauauagcgaagagucuaagcucaauagagagaaaauugauggcguuaagcuggaauccauggggguguaccagauccuggcuauuuauagcacagucgccuccucucucgugcugcuuguuagccugggagccaucuccuuuuggaugugcucuaacggcagccuccagugucggaucugcauuuga

SEQ ID NO: 185084 - RNA, 1698 nt, Artificial Sequence; identical to SEQ ID NO: 184938
  derived and/or modified sequence opt5 from hemagglutinin__InfluenzaA__ABW40367

SEQ ID NO: 185085 - RNA, 1701 nt, Artificial Sequence; identical to SEQ ID NO: 184952
  derived and/or modified sequence opt5 from hemagglutinin__InfluenzaA__ABW40378

SEQ ID NO: 185086 - RNA, 1698 nt, Artificial Sequence; identical to SEQ ID NO: 184938
  derived and/or modified sequence opt5 from hemagglutinin__InfluenzaA__ABW40389

SEQ ID NO: 185087 - RNA, 1698 nt, Artificial Sequence; identical to SEQ ID NO: 184934
  derived and/or modified sequence opt5 from hemagglutinin__InfluenzaA__ABW40400

SEQ ID NO: 185088 - RNA, 1698 nt, Artificial Sequence; identical to SEQ ID NO: 184934
  derived and/or modified sequence opt5 from hemagglutinin__InfluenzaA__ABW40411

SEQ ID NO: 185089 - RNA, 1698 nt, Artificial Sequence; identical to SEQ ID NO: 184934
  derived and/or modified sequence opt5 from hemagglutinin__InfluenzaA__ABW40422

SEQ ID NO: 185090 - RNA, 1698 nt, Artificial Sequence; identical to SEQ ID NO: 184980
  derived and/or modified sequence opt5 from hemagglutinin__InfluenzaA__ABW40433

SEQ ID NO: 185091 - RNA, 1698 nt, Artificial Sequence; identical to SEQ ID NO: 184954
  derived and/or modified sequence opt5 from hemagglutinin__InfluenzaA__ABW40444

SEQ ID NO: 185092 - RNA, 1698 nt, Artificial Sequence; identical to SEQ ID NO: 184971
  derived and/or modified sequence opt5 from hemagglutinin__InfluenzaA__ABW40455

SEQ ID NO: 185093 - RNA, 1698 nt, Artificial Sequence; identical to SEQ ID NO: 184938
  derived and/or modified sequence opt5 from hemagglutinin__InfluenzaA__ABW40466

SEQ ID NO: 185094 - RNA, 1698 nt, Artificial Sequence; identical to SEQ ID NO: 184938
  derived and/or modified sequence opt5 from hemagglutinin__InfluenzaA__ABW40477

SEQ ID NO: 185095 - RNA, 1698 nt, Artificial Sequence; identical to SEQ ID NO: 184934
  derived and/or modified sequence opt5 from hemagglutinin__InfluenzaA__ABW40488

SEQ ID NO: 185096 - RNA, 1698 nt, Artificial Sequence; identical to SEQ ID NO: 184938
  derived and/or modified sequence opt5 from hemagglutinin__InfluenzaA__ABW40499

SEQ ID NO: 185097 - RNA, 1698 nt, Artificial Sequence; identical to SEQ ID NO: 184980
  derived and/or modified sequence opt5 from hemagglutinin__InfluenzaA__ABW40510

SEQ ID NO: 185098 - RNA, 1698 nt, Artificial Sequence; identical to SEQ ID NO: 184934
  derived and/or modified sequence opt5 from hemagglutinin__InfluenzaA__ABW40521

SEQ ID NO: 185099 - RNA, 1698 nt, Artificial Sequence; identical to SEQ ID NO: 184938
  derived and/or modified sequence opt5 from hemagglutinin__InfluenzaA__ABW40532

SEQ ID NO: 185100 - RNA, 1698 nt, Artificial Sequence
  derived and/or modified sequence opt5 from hemagglutinin__InfluenzaA__ABW40543
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaccagcaaagaguccuggucuuacaucguggaaacgccgaaucccgagaacggcaccuguuauccuggguacuuugccgacuaugaggaacugcgggagcaacucagcuccgucucuagcuucgaacgcuuugagauuuuccccaaggaguccagcuggccuaaucauacagugaccggaguuucugccuccugcagccacaacggcaagucuuccuuuuacagaaaucugcuuuggcugacaggcaaaaacgggcucuaucccaaucugagcaagucuuacgcuaacaauaaagaaaaggaggugcugguccucuggggagugcaucacccuccgaacaucggcgaucagcgggcccuguaccacaccgaaaacgcuuauguguccgucguuagcucccauuacucucgcagauucacgcccgagaucgccaaacggccuaaggugcgcgaccaggaagggagaauuaauuauuacuggacacuucuggagcccggagauaccaucauuuuugaggcgaacggcaaucucaucgccccucgguucgcuuuugcccugagccgcggguucggauccggcauuaucacaagcaacgcucccauggacgaaugugaugccaagugccagaccccgcaaggcgcgauuaauucuucccuuccuuuucagaacgugcaccccgucaccaucggggaguguccuaaauaugugagaagcgccaagcugcggaugguuacaggacuccgcaauauccccucuauucagagcagaggccuguucggggcuaucgccggauuuauugaaggcggguggacgggaaugguggacggcugguacggcuaucaucaccagaacgagcaaggguccggauacgcugccgaucagaaaucuacccagaaugccaucaacggcauuacaaauaaggucaacagcgugaucgaaaagaugaauacccaguucacagcuguugggaaagaguucaacaaacuggagcggcgcauggaaaaucucaacaagaagguggacgauggauuucuggacaucuggaccuacaacgcggagcuucugguccuccuggaaaaugagagaacgcuugacuuccacgauuccaacgugaaaaaucuguaugaaaaggucaaaagccaacucaagaacaaugccaaagagauuggcaacgggugcuuugaguucuaccauaaguguaaugacgaaugcauggagucugugaagaacggcacauaugauuaccccaaauauuccgaagagagcaagcugaaucgggagaaaaucgacggaguuaagcuggaaucuaugggcguguaccagauucucgcuaucuauuccaccgucgccagcucccuggugcuucugguuucucucggggccauuagcuuuuggaugugcuccaacggaucucugcaguguagaaucugcaucuga

SEQ ID NO: 185101 - RNA, 1698 nt, Artificial Sequence; identical to SEQ ID NO: 185079
  derived and/or modified sequence opt5 from hemagglutinin__InfluenzaA__ABW40554

SEQ ID NO: 185102 - RNA, 1698 nt, Artificial Sequence; identical to SEQ ID NO: 184938
  derived and/or modified sequence opt5 from hemagglutinin__InfluenzaA__ABW40565

SEQ ID NO: 185103 - RNA, 1698 nt, Artificial Sequence
  derived and/or modified sequence opt5 from hemagglutinin__InfluenzaA__ABW40576
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacaccuaugugagcguggucuccucucauuacagccggcgcuucacgcccgagaucgcuaaaagaccuaagguucgggaccaggaagggcgcauuaauuauuacuggacacuucuggagcccggagauaccaucauucucgaggccaacggcaaucugaucgcgccuagauuugccuucgcucuuucccggggguuuggaagcggcauuaucacaucuaacgcccccauggacgaaugugaugcuaagugccagaccccgcaaggcgccaucaauuccagccugccuuuccagaacgugcaccccgugaccauuggggaguguccuaaauauguccgcucuacaaagcucagaauggugacgggacugcggaauauccccagcauucagucccgcggccuguuuggggcgaucgccggauucauugaaggcggguggaccggaaugguugacggcugguacggcuaucaucaccagaacgagcaagggucuggauacgcugccgaucagaaaagcacacagaaugcuaucaacggcaucaccaauaaggugaacuccgucauugaaaagaugaauacacaguuuaccgccguggggaaagaguucaacaaacucgagagacggauggaaaaucugaacaagaagguugacgauggauuccuugacaucuggacguacaacgccgagcugcucgugcugcuugaaaaugagcgcacacuggacuuucacgauagcaacgucaaaaaucucuaugaaaaggugaaaucucaacugaagaacaaugcuaaagagauuggcaacgggugcuucgaguuuuaccauaaguguaaugacgaaugcauggaguccgucaagaacggcaccuaugauuaccccaaauauagcgaagagucuaagcugaauagagagaaaaucgacggagugaagcucgaauccaugggcguuuaccagauucuggcgaucuauagcaccguggccuccucucuuguccugcucgugagccugggggcuaucuccuucuggaugugcucuaacggaagccugcagugucggauuugcaucuga

SEQ ID NO: 185104 - RNA, 1701 nt, Artificial Sequence; identical to SEQ ID NO: 185011
  derived and/or modified sequence opt5 from hemagglutinin__InfluenzaA__ABW40587

SEQ ID NO: 185105 - RNA, 1698 nt, Artificial Sequence; identical to SEQ ID NO: 184980
  derived and/or modified sequence opt5 from hemagglutinin__InfluenzaA__ABW40598

SEQ ID NO: 185106 - RNA, 1698 nt, Artificial Sequence; identical to SEQ ID NO: 184954
  derived and/or modified sequence opt5 from hemagglutinin__InfluenzaA__ABW40609

SEQ ID NO: 185107 - RNA, 1698 nt, Artificial Sequence; identical to SEQ ID NO: 184969
  derived and/or modified sequence opt5 from hemagglutinin__InfluenzaA__ABW40620

SEQ ID NO: 185108 - RNA, 1701 nt, Artificial Sequence; identical to SEQ ID NO: 185011
  derived and/or modified sequence opt5 from hemagglutinin__InfluenzaA__ABW40631

SEQ ID NO: 185109 - RNA, 1698 nt, Artificial Sequence; identical to SEQ ID NO: 184934
  derived and/or modified sequence opt5 from hemagglutinin__InfluenzaA__ABW40642

SEQ ID NO: 185110 - RNA, 1701 nt, Artificial Sequence; identical to SEQ ID NO: 185011
  derived and/or modified sequence opt5 from hemagglutinin__InfluenzaA__ABW40653

SEQ ID NO: 185111 - RNA, 1698 nt, Artificial Sequence; identical to SEQ ID NO: 184980
  derived and/or modified sequence opt5 from hemagglutinin__InfluenzaA__ABW40664

SEQ ID NO: 185112 - RNA, 1698 nt, Artificial Sequence; identical to SEQ ID NO: 184954
  derived and/or modified sequence opt5 from hemagglutinin__InfluenzaA__ABW40675

SEQ ID NO: 185113 - RNA, 1698 nt, Artificial Sequence; identical to SEQ ID NO: 185083
  derived and/or modified sequence opt5 from hemagglutinin__InfluenzaA__ABW71294

SEQ ID NO: 185114 - RNA, 1698 nt, Artificial Sequence; identical to SEQ ID NO: 184980
  derived and/or modified sequence opt5 from hemagglutinin__InfluenzaA__ABW71305

SEQ ID NO: 185115 - RNA, 1698 nt, Artificial Sequence
  derived and/or modified sequence opt5 from hemagglutinin__InfluenzaA__ABW71316
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccagagauacaaucauuuuugaggcgaacggaaaucucaucgccccucgguucgcuuuugcccugucccgcggcuucgggagcggaauuaucaccucuaacgcucccauggacgaaugugaugccaagugccagacaccgcaaggcgcgaucaauuccagccuuccuuuucagaacgugcaccccgugaccauuggcgaguguccuaaauaugucagaucuaccaagcugcggauggugacagggcuccgcaauauccccagcauucaguccagaggacuguucggcgccaucgcuggguuuauugaaggaggcuggacggggaugguugacggaugguacggcuaucaucaccagaacgagcaaggcucuggguacgccgcugaucagaaaagcacccagaaugccaucaacggaaucacaaauaaggugaacuccgucauugaaaagaugaauacccaguucacagccgugggcaaagaguucaacaaacuggagcggcgcauggaaaaucucaacaagaagguugacgauggguuucuggacaucuggaccuacaacgcugagcuucuggugcuccuggaaaaugagagaacgcuugacuuccacgauagcaacgucaaaaaucuguaugaaaaggugaaaucucaacucaagaacaaugcgaaagagauuggaaacggcugcuuugaguucuaccauaaguguaaugacgaaugcauggaguccgucaagaacgggacauaugauuaccccaaauauagcgaagagucuaagcugaaucgggagaaaaucgacggcgugaagcuggaauccaugggaguuuaccagauucucgccaucuauagcaccguggcuuccucucugguccuucuggugagccucggcgccaucuccuuuuggaugugcucuaacgggagccugcaguguagaauuugcaucuga

SEQ ID NO: 185116 - RNA, 1698 nt, Artificial Sequence; identical to SEQ ID NO: 184934
  derived and/or modified sequence opt5 from hemagglutinin__InfluenzaA__ABW71327

SEQ ID NO: 185117 - RNA, 1698 nt, Artificial Sequence; identical to SEQ ID NO: 184938
  derived and/or modified sequence opt5 from hemagglutinin__InfluenzaA__ABW71338

SEQ ID NO: 185118 - RNA, 1701 nt, Artificial Sequence; identical to SEQ ID NO: 184952
  derived and/or modified sequence opt5 from hemagglutinin__InfluenzaA__ABW71349

SEQ ID NO: 185119 - RNA, 1698 nt, Artificial Sequence
  derived and/or modified sequence opt5 from hemagglutinin__InfluenzaA__ABW71360
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagccggucuuacgcuaacaauaaggaaaaagaggugcugguccucuggggagugcaucacccuccgaacaucggcgaucagcgcgcccuguaccacacagaaaacgcuuauguguccgucguuagcucccauuacucuagacgguucacccccgagauugccaagcgcccuaaagugagagaccaggaagggcggaucaauuauuacuggacgcuucuggagcccggagauacaauuaucuuugaggcgaacggcaaucucauugccccucgcuucgcuuuugcccugagcagaggguucggauccggcaucauuaccagcaacgcucccauggacgaaugugaugccaagugccagacaccgcaaggcgcgaucaauucuucccuuccuuuucagaacgugcaccccgucaccaucggggaguguccuaaguaugugcggagcgccaaacugcgcaugguuaccggacucagaaauauucccucuauccagagccggggccuguucggggcuauugccggauuuaucgaaggcggguggacaggaaugguggacggcugguacggcuaucaucaccagaacgagcaaggguccggauacgcugccgaucagaagucuacgcagaaugccauuaacggcaucaccaauaaagucaacagcgugaucgaaaagaugaauacacaguucaccgcuguugggaaagaguucaacaagcuggagcgcagaauggaaaaucucaacaaaaagguggacgauggauuucuggacauuuggacauacaacgcggagcuucugguccuccuggaaaaugagcggacccuugacuuccacgauuccaacgugaagaaucuguaugaaaaagucaagagccaacucaaaaacaaugccaaggagaucggcaacgggugcuuugaguucuaccauaaaugugacgaugaaugcauggagucugugaagaauggcacguaugacuaccccaaguauuccgaagagagcaaacugaacagagagaagauugauggaguuaaacuggaaucuaugggcguguaccagauccucgcuauuuauuccacagucgccagcucccuggugcuucugguuucucucggggccaucagcuuuuggaugugcuccaauggaucucugcagugucgcaucugcauuuga

SEQ ID NO: 185120 - RNA, 1698 nt, Artificial Sequence; identical to SEQ ID NO: 184954
  derived and/or modified sequence opt5 from hemagglutinin__InfluenzaA__ABW71371

SEQ ID NO: 185121 - RNA, 1698 nt, Artificial Sequence
  derived and/or modified sequence opt5 from hemagglutinin__InfluenzaA__ABW71382
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuugguccaaucauaccauuacaggagucagcgccucuugcucccacaacggcaagagcucuuuuuaccgcaaucugcuuuggcugaccggcaaaaacgggcucuauccuaaucuguccaagagcuacgcuaacaauaaagaaaaggaggugcugguucucuggggagugcaucaucccccuaacaucggcgaucagagagcccuguaccacacagaaaacgcuuaugucuccguggugucuagccacuacucccggcgcuucaccccggagauugccaaaagacccaagguccgggaccaggaagggcgcaucaauuauuacuggacgcuucuggagccuggagauacaauuaucuuugaggcgaacggcaaucucauugcccccagauucgcuuuugcccugagccggggguucggaucuggcaucaucaccuccaacgcuccuauggacgaaugugaugccaagugccagacaccccaaggcgcgauuaauagcucucuuccguuucagaacguucacccugugaccaucggggagugucccaaauaugugcgcagcaccaagcugagaauggucacaggacuccggaauauuccuuccauccagucucgcggccuguucggggccauugcuggauuuaucgaaggcggguggacgggaaugguggacggcugguacggcuaucaucaccagaacgagcaagggagcggauacgccgcugaucagaaauccacccagaaugccaucaacggcauuacaaauaagguuaacagcgugaucgaaaagaugaauacccaguucacagccgucgggaaagaguucaacaaacuggagagacggauggaaaaucucaacaagaagguggacgauggauuucuggacauuuggaccuacaacgcugagcuucugguucuccuggaaaaugagcgcacgcuugacuuccacgauucuaacgugaaaaaucuguaugaaaaggucaaaucccaacucaagaacaaugcgaaagagaucggcaacgggugcuuugaguucuaccauaaguguaaugacgaaugcauggagagcgugaagaacggcacauaugauuaccccaaauauucugaagaguccaagcugaauagagagaaaauugacggagucaagcuggaaagcaugggcguguaccagauccucgccaucuauuccaccguugcuucuagccuggugcuucuggucucccucggggccauuucuuuuuggaugugcagcaacggaucccugcagugucggaucugcauuuga

SEQ ID NO: 185122 - RNA, 1698 nt, Artificial Sequence
  derived and/or modified sequence opt5 from hemagglutinin__InfluenzaA__ABW71393
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuuaccgacuaugaggaacugagagagcaacucuccucugucagcuccuucgaacgguuugagaucuuccccaaggagagcucuuggccuaaucauacagugaccggaguuuccgccagcugcucucacaacggcaaguccagcuuuuaccgcaaucugcuuuggcugacaggcaaaaacgggcucuaucccaaucugucuaaguccuacgccaacaauaaagaaaaggaggugcugguccucuggggagugcaucacccuccgaacaucggcgaucagagagcucuguaccacaccgaaaacgccuaugugagcgucguuuccucucauuacagccggcgcuucacgcccgagauugcuaaaagaccuaaggugcgggaccaggaagggcgcaucaauuauuacuggacacuucuggagcccggagauaccauuaucuuugaggccaacggcaaucucauugcgccuagauucgccuuugcucugucccggggguucggaagcggcaucauuacaucuaacgcccccaugggcgaaugugacgcuaagugccagaccccgcaaggggccaucaauuccagccuuccuuuucagaacgugcaccccgucaccaucggagaguguccuaaauaugugcgcucugcgaagcugagaaugguuacaggccuccggaauauucccagcauccagucccgcgggcuguucggagccauugcuggcuuuaucgaagggggauggacgggcaugguggauggcugguacggguaucaucaccagaacgagcaaggaucuggcuacgccgcugaccagaaaagcacccagaaugccauuaacgggaucacaaauaaggucaacuccgugaucgaaaagaugaauacccaguucacagccguuggaaaagaguucaacaaacuggagagacggauggaaaaucucaacaagaagguggaugacggcuuucuggauauuuggaccuacaacgcugagcuucugguccuccuggaaaaugagcgcacgcuugacuuccacgacagcaacgugaaaaaucuguaugaaaaggucaaaucucaacucaagaacaaugcgaaagagaucgggaacggcugcuuugaguucuaccauaaguguaaugaugaaugcauggaguccgugaagaacggaacauaugacuaccccaaauauagcgaagagucuaagcugaauagagagaaaauugauggcguuaagcuggaauccauggggguguaccagauccucgccauuuauagcaccgucgcuuccucucuggugcuucugguuagccucggagccaucuccuuuuggaugugcucuaacggcagccugcagugucggaucugcauuuga

SEQ ID NO: 185123 - RNA, 1698 nt, Artificial Sequence; identical to SEQ ID NO: 185083
  derived and/or modified sequence opt5 from hemagglutinin__InfluenzaA__ABW71404

SEQ ID NO: 185124 - RNA, 1698 nt, Artificial Sequence; identical to SEQ ID NO: 184971
  derived and/or modified sequence opt5 from hemagglutinin__InfluenzaA__ABW71415

SEQ ID NO: 185125 - RNA, 1698 nt, Artificial Sequence
  derived and/or modified sequence opt5 from hemagglutinin__InfluenzaA__ABW71426
augaaggccaaacugcucauccugcuuugcaccuucacagcuacguacgccgacaccauuuguaucggcuaucacgcgaacaauagcacagauaccguggacacaguccuggagaagaacguuaccgugacacauuccgugaaucuccuggaagauucucacaacgggaaacuuugccugcucaagggaauugcuccccugcagcugggcaauuguagcgucgccggguggauccucggaaacccugagugcgaacugcuuauuuccaaagagucuuggagcuacaucguggaaaccccgaaucccgagaacggcacguguuauccuggguacuuugccgacuaugaggaacugagagagcaacucuccucuguuagcuccuucgaacgguuugagaucuuccccaaggagagcucuuggccuaaucauaccgugacaggagucuccgcuagcugcucucacaacggcaaguccagcuuuuaccgcaaucugcuuuggcugaccggcaaaaacgggcucuaucccaaucugucuaaguccuacgccaacaauaaagaaaaggaggugcugguucucuggggagugcaucacccuccgaacauuggcgaucagagagcucuguaccacacagaaaacgccuaugucagcgugguguccucucauuacagccggcgcuucacccccgagaucgcgaaaagaccuaagguccgggaccaggaagggcgcauuaauuauuacuggacgcuucuggagcccggagauacaaucauuuuugaggccaacggcaaucucaucgcuccuagauucgccuuugcucugucccggggguucggaagcggcauuaucaccucuaacgcccccauggacgaaugugaugcgaagugccagacaccgcaaggcgccaucaauuccagccuuccuuuucagaacguucaccccgugaccauuggggaguguccuaaauaugugcgcucuaccaagcugagaauggucacaggacuccggaauauccccagcauucagucccgcggccuguucggggcuaucgccggauuuauugaaggcggguggacgggaaugguggacggcugguacggcuaucaucaccagaacgagcaagggucuggauacgcugccgaucagaaaagcacccagaaugccaucaacggcaucacaaauaagguuaacuccgugauugaaaagaugaauacccaguucacagcugucgggaaagaguucaacaaacuggagagacggauggaaaaucucaacaagaagguggacgauggauuucuggacaucuggaccuacaacgcggagcuucugguucuccuggaaaaugagcgcacgcuugacuuccacgauagcaacgugaaaaaucuguaugaaaaggucaaaucucaacucaagaacaaugccaaagagauuggcaacgggugcuuugaguucuaccauaaguguaaugacgaaugcauggaguccgugaagaacggcacauaugauuaccccaaauauagcgaagagucuaagcugaauagagagaaaaucgacggagucaagcuggaauccaugggcguguaccagauucucgcuaucuauagcaccguugccuccucucuggugcuucuggucagccucggggccaucuccuuuuggaugugcucuaacggaagccugcagugucggauuugcaucuga

SEQ ID NO: 185126 - RNA, 1698 nt, Artificial Sequence
  derived and/or modified sequence opt5 from hemagglutinin__InfluenzaA__ABW71448
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagucccgcggccuguucggggccauugcuggauuuaucgaaggcggguggacgggaaugguggacggcugguacggcuaucaucaccagaacgagcaagggucuggauacgccgcugaucagaaaagcacccagaaugccauuaacggcaucacaaauaaggucaacuccgugaucgaaaagaugaauacccaguucacagccguugggaaagaguucaacaaacuggagagacggauggaaaaucucaacaagaagguggacgauggauuucuggacauuuggaccuacaacgcugagcuucugguccuccuggaaaaugagcgcacgcuugacuuccacgauagcaacgugaaaaaucuguaugaaaaggucaaaucucaacucaagaacaaugcgaaagagaucggcaacgggugcuuugaguucuaccauaaguguaaugacgaaugcauggaguccgugaagaacggcacauaugauuaccccaaauauagcgaagagucuaagcugaauagagagaaaauugacggaguuaagcuggaauccaugggcguguaccagauccucgccauuuauagcaccaucgcuuccucucugguccuucuggugagccucggggccaucuccuuuuggaugugcucuaacggaagccugcagugucggauuugcaucuga

SEQ ID NO: 185127 - RNA, 1698 nt, Artificial Sequence; identical to SEQ ID NO: 184954
  derived and/or modified sequence opt5 from hemagglutinin__InfluenzaA__ABW71459

SEQ ID NO: 185128 - RNA, 1698 nt, Artificial Sequence; identical to SEQ ID NO: 184938
  derived and/or modified sequence opt5 from hemagglutinin__InfluenzaA__ABW71470

SEQ ID NO: 185129 - RNA, 1707 nt, Artificial Sequence
  derived and/or modified sequence opt5 from hemagglutinin__InfluenzaA__ABW74702
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggucuagcuccuuuuuccgcaacguuguguggcucaucaaaaagaauagcacauaucccaccauuaaaaagucuuacaacaauacaaaccaggaggaccugcuuguccuguggggaauccaccacccuaaugaugcugccgagcaaaccagacucuaucagaacccgacgaccuacaucuccauuggcacaagcacccugaaccagcggcuggugcccaagaucgcuacacgcuccaaagugaauggccagucugggagaauggaauuuuucuggaccauucucaagccuaacgacgccaucaauuuugagagcaacggaaauuucauugcgcccgaauacgccuauaaaaucgucaagaaaggcgauuccgcuaucaugaaaagcgagcuggaauacgggaacugcaauacgaaaugucaaacaccuaugggagccauuaacucuuccaugcccuuucauaauauccacccgcuuaccauuggcgagugcccuaaguauguuaagagcaaccggcuggugcucgcuacagggcugcgcaauucuccccagagagagagccggcgcaaaaagagaggacuuuucggcgccaucgcgggcuuuauugaagggggauggcagggcaugguggacgggugguacggauaucaucacuccaacgagcagggcucuggguacgccgcugacaaagaaagcacccaaaaggccaucgauggagucaccaauaaagugaacuccaucauugacaagaugaauacacaguucgaggcuguuggccgggaauuuaacaaccuggagcgcagaaucgagaaucucaacaagaaaauggaagauggcuuccuggacguguggacguauaaugccgagcugcucguccugauggaaaacgagcggacccuugauuuccacgacagcaaugugaagaaccuguacgauaaaguucgccuccagcugagagacaaugccaaggaacuugggaacggauguuuugaguucuaccauaaaugcgauaaugaguguauugaaucuauccggaacggcacauauaauuacccucaauauuccgaggaagcuagacugaagcgcgaggagauuagcggggugaagcucgaaucuaucggaaccuaccagauucuguccaucuauagcacagucgcguccucucuggcccucgcuaucaugauggccggccugagccuuuggaugugcuccaacgggucucugcagugccggauuuguaucuga

SEQ ID NO: 185130 - RNA, 1707 nt, Artificial Sequence
  derived and/or modified sequence opt5 from hemagglutinin__InfluenzaA__ABW74703
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugaaggauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaaacaucugcuuagcagaaucaaucacuucgagaagauucagaucauucccaaauccucuuggagcgaucaugaagccuccagcggcgugucuuccgccuguccuuaccuggggagccccuccuuuuuccggaacguuguguggcucaucaagaaaaauucuacauauccuaccauuaaaaagagcuacaacaauacaaaccaggaggaccugcuuguccuguggggaauccaccacccgaaugaugcugccgagcaaacccgccucuaucagaaccccacgaccuacaucucuauuggcacauccacccugaaccagagacuggugccuaaaaucgcuacacggagcaaggugaauggccaguccgggcgcauggaauuuuucuggaccauucucaaacccaacgacgccgucaauuuugagucuaacggaaauuucaucgcgccugaauacgccuauaagauuguuaaaaagggcgauagcgcuaucaugaaauccgagcuggaauacgggaacugcaauacgaagugucaaacacccaugggagccaucaacagcucuaugccguuucauaauauucacccucuuaccaucggcgagugccccaaguaugugaaauccaacagacuggugcucgcuacagggcugcggaauagcccucagcgcgagucuagacggaagaaacgcggacuuuucggcgccauugcgggcuuuaucgaagggggauggcagggcauggucgacgggugguacggauaucaucacagcaacgagcagggcuccggguacgccgcugacaaggaaucuacccaaaaagccauugauggagugaccaauaagguuaacagcaucaucgacaagaugaauacacaguucgaggcugugggcagagaauuuaacucccuggagcggcgcauugagaaccucaauaaaaagauggaagauggcuuccuggacgucuggacguauaacgccgagcugcucgugcugauggaaaaugagagaacccuugauuuccacgacagcaacguuaaaaaucuguacgauaaggugcggcuccagcugcgcgacaacgccaaagaacuugggaauggauguuuugaguucuaccauaagugcgauaacgaguguauggaaucuaucagaaauggcacauauaacuacccccaauauuccgaggaagcucggcugaagagagaggagauuagcggggucaaacucgaaucuaucggaaccuaccagauucuguccaucuauagcacaguggcguccucucuggcccucgcuauuaugaucgccggccugagccuuuggaugugcuccaaugggucucugcagugccgcaucuguauuuga

SEQ ID NO: 185131 - RNA, 1707 nt, Artificial Sequence
  derived and/or modified sequence opt5 from hemagglutinin__InfluenzaA__ABW74705
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucuggaccauucucaagcccaacgacgccaucaauuuugagucuaacggaaauuucauugcgccugaauacgccuauaaaaucgucaagaaaggcgauagcgcuaucaugaaguccgagcuggaauacgggaacugcaauacgaaaugucaaacacccaugggagccauuaacagcucuaugccguuucauaauauccacccucuuaccauuggcgagugccccaaguauguuaaguccaaccggcuggugcucgcuacagggcugcgcaauagcccucagagagagucucggcgcaaaaagagaggacuuuucggcgccaucgcgggcuuuauugaagggggauggcagggcaugguggacgggugguacggauaucaucacagcaacgagcagggcuccggguacgccgcugacaaagaaucuacccaaaaggccaucgauggagucaccaauaaagugaacagcaucauugacaagaugaauacacaguucgaggcuguuggccgggaauuuaacaaccuggagcgcagaaucgagaaucucaacaagaaaauggaagauggcuuccuggacguguggacguauaaugccgagcugcucguccugauggaaaacgagcggacccuugauuuccacgacuccaaugugaagaaccuguacgauaaaguucgccuccagcugagagacaaugccaaggaacuugggaacggauguuuugaguucuaccauaaaugcgauaaugaguguauggaaagcauucggaacggcacauauaauuacccccaauauucugaggaagcuagacugaagcgcgaggagaucuccggggugaagcucgaaagcauuggaaccuaccagauccugucuauuuauuccacagucgcgagcucccuggcccucgcuaucaugaucgccggccugucucuuuggaugugcagcaacgggucccugcagugccggauuuguaucuga

SEQ ID NO: 185132 - RNA, 1707 nt, Artificial Sequence
  derived and/or modified sequence opt5 from hemagglutinin__InfluenzaA__ABW74707
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagauggcuacacgcagcaaagugaauggccaguccgggagaauggaauuuuucuggaccauccucaagcccaacgacgccauuaauuuugagucuaacggaaauuucaucgcgccugaauacgccuauaaaauugucaagaaaggcgauagcgcuaucaugaaguccgagcuggaauacgggaacugcaauacgaaaugucaaacacccaugggagccaucaacagcucuaugccguuucauaauauucacccucuuaccaucggcgagugccccaaguauguuaaguccaaccggcuggugcucgcuacagggcugcgcaauagcccucagagagagucucggcgcaaaaagagaggacuuuucggcgccauugcgggcuuuaucgaagggggauggcagggcaugguggacgggugguacggauaucaucacagcaacgagcagggcuccggguacgccgcugacaaagaaucuacccaaaaggccauugauggagucaccaauaaagugaacagcaucaucgacaagaugaauacacaguucgaggcuguuggccgggaauuuaacaaccuggagcgcagaauugagaaucucaacaagaaaauggaagauggcuuccuggacguguggacguauaaugccgagcugcucguccugauggaaaacgagcggacccuugauuuccacgacuccaaugugaagaaccuguacgauaaaguucgccuccagcugagagacaaugccaaggaacuugggaacggauguuuugaguucuaccauaaaugcgauaaugaguguauggaaagcauccggaacggcacauauaauuacccccaauauucugaggaagcuagacugaagcgcgaggagauuuccggggugaagcucgaaagcaucggaaccuaccagauucugucuaucuauuccacagucgcgagcucccuggcccucgcuauuaugaucgccggccugucucuuuggaugugcagcaacgggucccugcagugccggaucuguauuuga

SEQ ID NO: 185133 - RNA, 1707 nt, Artificial Sequence
  derived and/or modified sequence opt5 from hemagglutinin__InfluenzaA__ABW74708
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccaccaaugaucugugcuacccuggaucuuuuaacgacuaugaggaacucaagcaucugcuuagccggaucaaucacuucgagaaaauucagaucauucccaaguccucuuggagcgaucaugaagccuccagcggcgugucuuccgccuguccuuaccuggggagccccuccuuuuuccgcaacguuguguggcucaucaaaaagaacucuacauauccuaccauuaaaaagagcuacaauaauacaaaccaggaggaccugcuuguccuguggggaauccaccacccgaaugaugcugccgagcaaaccagacucuaucagaaccccacgaccuacaucucuauuggcacauccacccugaaccagcggcuggugccuaagaucgcuacacgcagcaaagugaauggccaguccgggagaauggaauuuuucuggaccauucucaagcccaacgacgccaucaauuuugagucuaacggaaauuucauugcgccugaauacgccuauaaaaucgucaagaaaggcgauagcgcuaucaugaaguccgagcuggaauacgggaacugcaauacgaaaugucaaacacccaugggagccauuaacagcucuaugccguuucauaauauccacccucuuaccauuggcgagugccccaaguauguuaaguccaaccggagcgugcuggcuacagggcuccgcaauucuccucagagagagagccggcgcaaaaagagaggacuguucggcgccaucgcgggcuuuauugaagggggauggcagggcaugguggacgggugguacggauaucaucacuccaacgagcagggcucuggguacgccgcugacaaagaaagcacccaaaaggccaucgauggagucaccaauaaagugaacuccaucauugacaagaugaauacacaguucgaggcuguuggccgggaauuuaacaaccuugagcgcagaaucgagaaucugaacaagaaaauggaagauggcuuccucgacguguggacguauaaugccgagcugcugguccucauggaaaacgagcggacccuggauuuccacgacagcaaugugaagaaccuuuacgauaaaguucgccugcagcucagagacaaugccaaggaacuggggaacggauguuuugaguucuaccauaaaugcgauaaugaguguauggaaucuauucggaacggcacauauaauuacccccaauauuccgaggaagcuagacuuaagcgcgaggagaucagcggggugaagcuggaaucuauuggaaccuaccagauccucuccauuuauagcacagucgcguccucucuggcccuggcuaucaugauggccggccucagccuguggaugugcuccaacgggucucuucagugccggaucuguauuuga

SEQ ID NO: 185134 - RNA, 1707 nt, Artificial Sequence; identical to SEQ ID NO: 185131
  derived and/or modified sequence opt5 from hemagglutinin__InfluenzaA__ABW74710

SEQ ID NO: 185135 - RNA, 1707 nt, Artificial Sequence; identical to SEQ ID NO: 185131
  derived and/or modified sequence opt5 from hemagglutinin__InfluenzaA__ABW74711

SEQ ID NO: 185136 - RNA, 1707 nt, Artificial Sequence
  derived and/or modified sequence opt5 from hemagglutinin__InfluenzaA__ABW74712
auggagaagaucgugcugcuccugagcauugucucccuuguuaaaucugaccagaucugcauuggcuaccacgccaacaauagcaccgaacaaguggauacaaucauggagaagaacgugacggucacccaugcucaggacauucuggaaaagacacacaaugggaagcucugugaucuggacggagugaaaccccuuauccugagagauugcuccguugccggcuggcuccuggggaacccuaugugugacgaguucaucaaugugccggaauggucuuauauugucgagaaggcgaaccccaccaaugaucugugcuacccuggcagcuuuaacgacuaugaggaacucaagcaucugcuuucccggaucaaucacuucgagaaaauucagaucauucccaagucuagcugguccgaucaugaagcuagcucuggaguguccagcgccuguccuuaccuggggucucccuccuuuuuccgcaacguuguguggcucaucaaaaagaauagcacauauccuaccauuaaaaagucuuacaacaauacaaaccaggaggaccugcuuguccuguggggaauccaccacccgaauaacgaggaagaacaaaccagacucuaucagaaccccacgaccuacaucuccauuggcacaagcacccugaaucagcggcuggugccuaagaucgccacacgcuccaaagugaacggccagucugggagaauggaauuuuucuggaccauucucaagcccaaugaugcuaucaacuuugagagcaauggaaacuucauugccccugaauacgcuuauaaaaucgucaagaaaggcgacuccgccaucaugaaaagcgagcuggaguacucuaauugcaacacgaaaugucaaacacccaugggggcgauuaauuccagcaugccguuucauaacauccacccucuuaccauuggagaaugccccaaguauguuaagucuagccggcuggugcucgccacaggccugcgcaauuccccucagagagagucucggcgcaaaaagagagggcuuuucggagcuaucgccggcuuuauugaaggcggguggcagggaaugguggauggcugguacggguaucaucacagcaacgagcagggauccggcuacgcugccgacaaagaaagcacccaaaaggcgaucgacggggucaccaauaaagugaacucuaucauugauaagaugaauacacaguucgaggccguuggacgggaguuuaacaaccuggaacgcagaaucgagaaucucaacaagaaaauggaagacggcuuccuggauguguggacguauaaugcugagcugcucguccugauggaaaacgagcggacccuugacuuccacgauuccaaugugaagaaccuguacgacaaaguucgccuccagcugagagauaaugccaaggagcuuggcaacggguguuuugaguucuaccauaaaugcgacaaugaguguauggaaagcauucggaacggaacauauaauuacccccaauauucugaggaggcuagacugaagcgcgaagagaucuccggcgugaagcucgaaagcauugggaccuaccagauccuguccauuuauucuacagucgccagcucccuggcccucgcuaucaugaucgcgggacugucucuuuggaugugcagcaacggcucccugcagugccggauuuguaucuga

SEQ ID NO: 185137 - RNA, 1701 nt, Artificial Sequence
  derived and/or modified sequence opt5 from hemagglutinin__InfluenzaA__ABW80976
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaucuagaauuugcgacagcccgcaccagauccuggauggcgagaauuguacccucaucgacgcccugcugggggauccccauugcgacggauuucagaacaaagaaugggaucucuucgucgagcgguccaaggccuauucuaauuguuacccuuaugacgugcccgauuacguuagccugcgcucccuuguggcuagcucuggcacgcuggaauuuaacaaugaguccuucaacuggaccggggucgcccaaaauggaacaagcucugcuugcaaaagacgguccgacaagagcuuuuucucucgccucaacuggcugcaccagcuuaaguauaaauacccugcccugaaugugaccaugcccaacaaugagaaguuugauaaacucuauauuuggggcguucaucacccuggcacagacuccgaucagaucagcauuuacgcgcaggccuccgggagagugaccgucucuacgaagcggagccaacagacagugaucccgaacauuggaucccgccccugggugagaggcgucagcucugggaucuccauuuacuggaccaucguuaaaccuggagacauccugcugauuaacagcacaggcaaucucaucgcuccccggggguauuucaagauucgcucuggaaagagcuccaucaugagaucugacgccccuauuggcaaauguaacagcgaaugcaucacccccaauggcuccaucccgaacgauaagccuuuucagaaugugaaccggauuaccuacggggcuuguccccgcuaugugaaacagaauacacugaaacuugccacgggaaugagaaacgucccugagaagcaaacccggggcaucuucggggcgauugccggauuuaucgaaaauggcugggaggggaugauggacggaugguacggcuuccgccaccagaacagcgagggcacagggcaggcugccgaucugaagucuacccaagcugccauuaaucagaucaacggaaaacucaauagacugaucgaaaagacaaacgagaaguuucaucagauugaaaaagaguucuccgaaguggagggccggauccaggaccuugagaaguauguugaagauaccaaaauugaccuguggagcuacaaugccgagcuccugguggcucuggaaaaccaacacacgaucgaucucacagacucugagaugaacaagcuguucgaaagaaccaaaaagcagcuucgcgagaaugcggaggauauggggaacggaugcuuuaagauuuaucauaaaugugacaaugccugcaucggcuccauucggaacgggaccuacgaucacgacgucuacagagacgaagcucugaauaaccgcuuccagaucaagggcguggagcucaaaagcggauauaaggauuggauccuguggauuuccuuugccaucucuugcuuccuucuguguauuguucuccugggcuuuaucaugugggccugccagaaagggaauauucgguguaacaucugcaucuga

SEQ ID NO: 185138 - RNA, 1701 nt, Artificial Sequence
  derived and/or modified sequence opt5 from hemagglutinin__InfluenzaA__ABW80977
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuaaucucuaugcgcaggccucuggccgcaucacaguuuccaccaaaagaagccaacagacagugauuccgaacaucgggucccggccccgcgucagagaugugccuucucggauuagcaucuacuggaccaucgugaagcccggagacauucugcugaucuccagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguauggggcuuguccuagauacguuaagcagaauacccugaaacuugccacaggaaugcggaacgugcccgaaaagcaaacccgcggcauuuuuggggcgaucgccggauucauugagaauggcugggaagggaugguggacggaugguauggcuuuagacaccagaacucugagggcacagggcaggcugccgaucugaaaagcacccaagcugccaucaaucagaucaacggaaagcucaaucggcugauuggcaagacgaacgagaaauuccaccagaucgaaaaggaguucuccgaagucgaggggcgcauucaggaccuugaaaaauacguggaggauacaaagaucgaccuguggagcuauaacgccgagcuccugguugcucuggaaaaucaacauaccauugaucucaccgacucugagaugaacaaacuguuugaaagaacaaagaagcagcuucgggagaaugcggaagauaugggaaacggcugcuucaaaaucuaccacaagugugacaaugccugcauuggguccaucagaaacggcaccuaugaucaugacguguaccgcgacgaggcucugaauaaccgguuucagaucaaaggagucgagcucaagagcggcuacaaagauuggauucuguggaucucuuucgccauuuccugcuuucuucuguguguggcccuccugggguucaucaugugggcuugccagaagggaaauauuagauguaacaucugcaucuga

SEQ ID NO: 185139 - RNA, 1698 nt, Artificial Sequence
  derived and/or modified sequence opt5 from hemagglutinin__InfluenzaA__ABW80979
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuaaguccuacguuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuugguaugcuuucgcccuguccagaggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcggucugccaagcugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagcgcagaauggaaaaccucaacaagaagguggaugacggauuccuggauauuuggacauauaaugcggagcuucugguccuccuggaaaacgagcggacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaaucgcgagaaaauugacggaguuaagcuggaauccaugggcguguaucagauccucgcuauuuacagcacagucgccuccucucuggugcuucugguuagccucggggccaucuccuucuggaugugcucuaacggaagccugcaguguagaaucugcauuuga

SEQ ID NO: 185140 - RNA, 1701 nt, Artificial Sequence
  derived and/or modified sequence opt5 from hemagglutinin__InfluenzaA__ABW81505
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugcagacugaagggaaccgcuccccuccagcugggcaauuguagcaucgccggguggauucugggaaacccugagugcgaaucccucuuuucuaaagagagcugguccuacaucgccgaaacgccgaaucccaagaacggcaccuguuauccuggguacuucgcugacuaugaggagcugcgggaacaacuuucuagcguguccagcuuugagcgcuucgaaauuuuucccaaggauucuuccuggccuaaucauacaguuaccaaaggagugacagccagcugcucucacaacggcaaguccagcuucuacaaaaaucugcucuggcugaccgagaagaacggccuuuaucccaaucugucuaaauccuacgucaacaagaaggggaaagaggugcucguucuguggggagugcaucacccuagcaauaugggcgaccagagagcuaucuaccacaaggaaaacgccuaugucuccgugcugucuagccauuacucccggcgcuuuacgccggagaucgcgaaaagacccaaggugcgggaucaggaagggcgcauuaacuauuacuggacacuccuggagccuggagacaccaucauuuucgaagccaauggcaaccuuaucgcucccugguaugccuuugcucugagcagaggguucggaucuggcauuaucauuuccaaugccagcaugggcgagugugaugcgaaaugccagacaccucaaggggccaucaacucuagccuccccuuucagaauguccacccgguuaccaucggagaguguccuaaguacgugcgguccaccaaacugcgcauggugacaggccuuagaaacguccccucuauucagagccgggggcuguucggagcuaucgccggcuuuauugaagggggauggacgggcaugaucgacggcugguauggguaccaucaccagaaugagcaaggauccggcuacgcugccgaucagaaaagcacccagaacgccauuaaugggaucacaaacaagguuaauucuaucauugaaaagaugaacacccaguucacagcugugggaaaggaguucaauaaacucgaacgcagaauggagaaccugaauaagaaaguggacgauggcuuucuggacaucuggaccuauaacgcggagcuccugguccuucuggaaaacgagcggacgcucgacuuccacgauuccaaugugaagaaccuguacgaaaagguuaaaacacaacuuaagaauaacgccaaagagauugggaauggcugcuuugaguucuaucauaaguguaacaaugaaugcauggagagcgugaaaaacggaaccuacgacuauccuaaguacucuaaggaauccaaacugaaucgcgagaagaucgauggcgucaaacucgaaagcauggggguguaucagauucuggcuaucuacuccaccgucgccucuagccuggugcuccugguuucccuuggagccaucucuuuuuggaugugcagcaacggcucccugcaguguagaauuugcaucuga

SEQ ID NO: 185141 - RNA, 1698 nt, Artificial Sequence
  derived and/or modified sequence opt5 from hemagglutinin__InfluenzaA__ABW81506
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcaaccagagagcccuguaccacacagaaaaugcuuaugugagcgucguuuccucucauuacagccggcgcuucacccccgagauugccaaaagaccuaaggugcgggaucaggaagggcgcaucaacuauuacuggacgcuucuggagcccggagacacaauuaucuuugaggcgaauggcaaccucauugccccuugguaugcuuucgcccuguccagaggguuuggaagcggcaucauuaccucuaaugcucccauggaugaaugugacgccaagugccagacaccgcaaggcgcgaucaacuccagccuuccuuuccagaaugugcaccccgucaccaucggggaguguccuaaauacgugcggucugccaagcugcgcaugguuaccggacucagaaacauucccagcauccagucccggggccuguuuggggcuauugccggauucaucgaaggcggguggacaggaaugguggauggcugguauggcuaccaucaccagaaugagcaagggucuggauacgcugccgaccagaaaagcacgcagaacgccauuaauggcaucaccaacaaggucaauuccgugaucgaaaagaugaacacacaguuuaccgcuguugggaaagaguucaauaaacuggagcgcagaauggaaaaccucaacaagaagguggaugacggauuccuggauauuuggacauauaaugcggagcuucugguccuccuggaaaacgagcggacccuugacuuucacgacagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacguacgauuaucccaaauacagcgaagagucuaagcugaaucgcgagaaaauugacggaguuaagcuggaauccaugggcaucuaucagauucucgcuaucuacagcacaguggccuccucucugguccuucuggugagccucggggccaucuccuucuggaugugcucuaacggaagccugcaguguagaauuugcaucuga

SEQ ID NO: 185142 - RNA, 1701 nt, Artificial Sequence
  derived and/or modified sequence opt5 from hemagglutinin__InfluenzaA__ABW81507
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugcagacugaagggaaccgugccccuccagcugggcaauuguagcaucgcuggguggauucugggaaacccugagugcgaaucccucuuuucuaaagagagcugguccuacaucgccgaaacgccgaaucccaagaacggcaccuguuauccuggguacuucgccgacuaugaggagcugcgggaacaacuuucuagcguuuccagcuuugagcgcuucgaaauuuuucccaaggauucuuccuggccuaaucauacagugaccaaaggagucacagcuagcugcucucacaacggcaaguccagcuucuacaaaaaucugcucuggcugaccgagaagaacggccuuuaucccaaucugucuaaauccuacgugaacaagaaggggaaagagguucucgugcuguggggaguccaucacccuagcaauaugggcgaccagagagccaucuaccacaaggaaaacgcuuauguguccgugcugucuagccauuacucccggcgcuuuacgccggagaucgccaaaagacccaagguccgggaucaggaagggcgcauuaacuauuacuggacacuccuggagccuggagacaccaucauuuucgaagcgaauggcaaccuuaucgcccccugguaugcuuuugcccugagcagaggguucggaucuggcauuaucauuuccaaugcuagcaugggcgagugugaugccaaaugccagacaccucaaggggcgaucaacucuagccuccccuuucagaauguucacccggugaccaucggagaguguccuaaguacgugcgguccaccaaacugcgcauggucacaggccuuagaaacgugcccucuauucagagccgggggcuguucggagccaucgcuggcuuuauugaagggggauggacgggcaugaucgacggcugguauggguaccaucaccagaaugagcaaggauccggcuacgccgcugaucagaaaagcacccagaacgccauuaaugggaucacaaacaagguuaauucuaucauugaaaagaugaacacccaguucacagccgugggaaaggaguucaauaaacucgaacgcagaauggagaaccugaauaagaaagucgacgauggcuuucuggacaucuggaccuauaacgcugagcuccuggugcuucuggaaaacgagcggacgcucgacuuccacgauuccaauguuaagaaccuguacgaaaaggugaaaacacaacuuaagaauaacgcgaaagagauugggaauggcugcuuugaguucuaucauaaguguaacaaugaaugcauggagagcgucaaaaacggaaccuacgacuauccuaaguacucuaaggaauccaaacugaaucgcgagaagaucgauggcgugaaacucgaaagcaugggggucuaucagauucuggccaucuacuccaccguggcuucuagccugguucuccuggugucccuuggagccaucucuuuuuggaugugcagcaacggcucccugcaguguagaauuugcaucuga

SEQ ID NO: 185143 - RNA, 1698 nt, Artificial Sequence
  derived and/or modified sequence opt5 from hemagglutinin__InfluenzaA__ABW81508
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugacccggaaaaacggccucuaucccaaucugucuaaguccuacgcuaacaauaaagaaaaggaggugcugguccucuggggagugcaucacccuccgaacaucggggaucagagagcccuguaccacacagaaaacgcuuaugugagcgucguuuccucucauuacagccgcagauucacccccgagauugccaaacggccuaaggugcgcgaccaggaaggcagaaucaauuauuacuggacgcuucuggagcccggggauacaauuaucuuugaggcgaacggaaaucucauugccccucgguaugcuuucgcccugucccgcggcuuugggagcggaaucauuaccucuaacgcucccauggacgaaugugaugccaagugccagacaccgcaaggcgcgaucaauuccagccuuccuuuccagaacgugcaccccgucaccaucggcgaguguccuaaauacgugagaucugccaagcugcggaugguuaccgggcuccgcaauauucccagcauccaguccagaggacuguuuggcgcuauugccggguucaucgaaggaggcuggacagggaugguggacggaugguauggcuaccaucaccagaacgagcaaggcucuggguacgcugccgaucagaaaagcacgcagaaugccauuaacggaaucaccaauaaggucaacuccgugaucgaaaagaugaauacacaguuuaccgcuguuggcaaagaguucaacaaacuggagcggcgcauggaaaaucucaacaagaagguggacgauggguuccuggacauuuggacauauaacgcggagcuucugguccuccuggaaaaugagagaacccuugacuuucacgauagcaacgugaaaaaucuguacgaaaaggucaaaucucaacucaagaacaaugccaaagagaucggaaacggcugcuucgaguuuuaucauaaguguaaugacgaaugcauggaguccgugaagaacgggacguacgauuaucccaaauacagcgaagagucuaagcugaaucgggagaaaauugacggcguuaagcuggaauccaugggaguguaucagauccucgcuauuuacagcacagucgccuccucucuggugcuucugguuagccucggcgccaucuccuucuggaugugcucuaacgggagccugcaguguagaaucugcauuuga

SEQ ID NO: 185144 - RNA, 1701 nt, Artificial Sequence; identical to SEQ ID NO: 185140
  derived and/or modified sequence opt5 from hemagglutinin__InfluenzaA__ABW81509

SEQ ID NO: 185145 - RNA, 1698 nt, Artificial Sequence
  derived and/or modified sequence opt5 from hemagglutinin__InfluenzaA__ABW81511
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacuccauuaucuuugaggcgaaugggaaccucauugccccuugguaugcuuucgcccugagcagaggauuuggcucuggcaucauuacauccaaugcucccauggaugagugugacgccaagugccagaccccgcaaggggcgaucaacagcucucuuccuuuccagaaugugcaccccgucacaaucggagaauguccuaaguacgugcggagcgccaaacugcgcaugguuaccggccucagaaacauucccuccauccagucucgggggcuguuuggagcuauugccggcuucaucgaagggggauggaccggcaugguggauggcugguauggguaccaucaccagaaugaacaaggaagcggcuacgcugccgaccagaaguccacacagaacgccauuaaugggaucacgaacaaagucaauagcgugaucgagaagaugaacacccaguuuacagcuguuggaaaagaguucaauaagcuggagcgcagaauggagaaccucaacaaaaagguggaugacggcuuccuggauauuuggaccuauaaugcggaacuucugguccuccuggagaacgaacggacacuugacuuucacgacucuaaugugaagaaccuguacgagaaagucaagucccaacucaaaaauaacgccaaggaaaucgggaauggcugcuucgaguuuuaucauaaauguaacaaugagugcauggaaagcgugaagaacggaaccuacgauuaucccaaguacucugaggaauccaaacugaaucgcgagaagauugacggcguuaaacuggagagcauggggguguaucagauccucgcuauuuacuccacggucgccucuagccuggugcuucugguuucccucggagccaucucuuucuggaugugcagcaacggcucccugcaguguagaaucugcauuuga

SEQ ID NO: 185146 - RNA, 1698 nt, Artificial Sequence; identical to SEQ ID NO: 183320
  derived and/or modified sequence opt5 from hemagglutinin__InfluenzaA__ABW81512

SEQ ID NO: 185147 - RNA, 1698 nt, Artificial Sequence; identical to SEQ ID NO: 184409
  derived and/or modified sequence opt5 from hemagglutinin__InfluenzaA__ABW81513

SEQ ID NO: 185148 - RNA, 1698 nt, Artificial Sequence
  derived and/or modified sequence opt5 from hemagglutinin__InfluenzaA__ABW81514
augaaggugaaacugcucguccugcuuugcaccuucacagccacguacgcugacaccaucuguauuagcuaucacgccaacaauuccacagauaccguugacacagugcuggagaagaacgugaccgucacacauucugugaaucuccuggaagauagccacaacggcaaacuuugccugcucaaggggaucgcgccccugcagcugggaaauuguuccguugcuggcuggauucucgggaacccugagugcgaacugcuuaucucuaaagagagcugguccuacauuguggaaaccccgaaucccgagaacggaacguguuauccuggcuacuuugccgacuaugaggaacugagagagcaacucucuagcgucuccagcuucgaacgguuugagaucuuccccaaggagucuuccuggccuaaucauaccgugacagggguuagcgccucuugcucccacaacggaaagagcucuuuuuaccgcaaucugcuuuggcugaccggcaaaaacggccucuaucccaaucuguccaagagcuacgcuaacaauaaagaaaaggaggugcugguccucuggggagugcaucacccuccgaacaucggggaucagagagcccuguaccacacagaaaacgcuuauguguccgucguuucuagccauuacucccggcgcuucacccccgagauugccaaaagaccuaaggugcgggaccaggaaggccgcaucaauuauuacuggacgcuucuggagcccggggauacaauuaucuuugaggcgaacggaaaucucauugccccuagauucgcuuuugcccugagccggggcuucgggucuggaaucauuaccuccaacgcucccauggacgaaugugaugccaagugccagacaccgcaaggcgcgaucaauagcucucuuccuuuucagaacgugcaccccgucaccaucggcgaguguccuaaauaugugcgcagcgccaagcugagaauggcuaccgggcuccggaauauucccuccauccagucucgcggacuguucggcgccauugcuggguuuaucgaaggaggcuggacagggaugguugacggaugguacggcuaucaucaccagaacgagcaaggcagcggguacgccgccgaucagaaauccacgcagaaugcuauuaacggaaucaccaauaaggugaacagcgucaucgaaaagaugaauacacaguucaccgcggugggcaaagaguucucuaaacuggagagacggauggaaaaccucaauaagaagguugacgauggguuucuggacauuuggacauacaacgccgagcuucuggugcuccuggaaaacgagcgcacccuugacuuccacgauuccaaugucaaaaaccuguaugaaaaggugaaaagccaacucaagaauaacgcuaaagagaucggaaauggcugcuuugaguucuaccauaaguguaacgacgaaugcauggagucugucaagaaugggacguaugauuaccccaaauauuccgaagagagcaagcugaacagagagaaaauugacggcgugaagcuggaauccaugggaguuuaccagauccucgccauuuauucuacaguggccagcucccugguccuucuggugucucucggcgcuaucagcuuuuggaugugcuccaaugggagccugcagugucggaucugcauuuga

SEQ ID NO: 185149 - RNA, 1698 nt, Artificial Sequence; identical to SEQ ID NO: 184409
  derived and/or modified sequence opt5 from hemagglutinin__InfluenzaA__ABW81515

SEQ ID NO: 185150 - RNA, 1698 nt, Artificial Sequence; identical to SEQ ID NO: 184409
  derived and/or modified sequence opt5 from hemagglutinin__InfluenzaA__ABW81516

SEQ ID NO: 185151 - RNA, 1698 nt, Artificial Sequence
  derived and/or modified sequence opt5 from hemagglutinin__InfluenzaA__ABW81517
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucuaucagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucugccaagcugagaauggcuaccggacuccggaauauccccagcauucagucccgcggccuguucggggccaucgcuggauuuauugaaggcggguggacaggaaugguggacggcugguacggcuaucaucaccagaacgagcaagggucuggauacgccgccgaucagaaaagcacgcagaaugcuaucaacggcaucaccaauaagguuaacuccgugauugaaaagaugaauacacaguucaccgcggucgggaaagaguucagcaaacuggagagacggauggaaaaccucaauaagaagguggacgauggauuucuggacaucuggacauacaacgccgagcuucugguucuccuggaaaacgagcgcacccuugacuuccacgauucuaaugugaaaaaccuguaugaaaaggucaaaucccaacucaagaauaacgcuaaagagauuggcaaugggugcuuugaguucuaccauaaguguaacgacgaaugcauggagagcgugaagaauggcacguaugauuaccccaaauauucugaagaguccaagcugaacagagagaaaaucgacggagucaagcuggaaagcaugggcguguaccagauucucgccaucuauuccacaguugccucuagccuggugcuucuggucucccucggggcuaucucuuuuuggaugugcagcaauggaucccugcagugucggauuugcaucuga

SEQ ID NO: 185152 - RNA, 1698 nt, Artificial Sequence
  derived and/or modified sequence opt5 from hemagglutinin__InfluenzaA__ABW81518
augaaggugaaacugcucguccugcuuugcaccuacacagccacguaugcugacaccaucuguauuggcuaccacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuauauuguggaaaccccgaaucccgagaacggcacguguuacccuggguauuucgccgacuacgaggaacugagagagcaacucuccucugucagcuccuuugaacgguucgagaucuuucccaaggagagcucuuggccuaaucauaccgugacaggaguuuccgccagcugcucucacaacggcaaguccagcuucuaucgcaaucugcuuuggcugaccggcaaaaacgggcucuaccccaaucugucuaaguccuacgcuaacaauaaagaaaaggaggugcugguccucuggggagugcaucacccuccgaacaucggcgaucagagagcccuguaucacacagaaaacgcuuacgugagcgucguuuccucucauuauagccggcgcuuuacccccgagauugccaaaagaccuaaggugcgggaccaggaagggcgcaucaauuacuauuggacgcuucuggagcccggagauacaauuaucuucgaggcgaacggcaaucucauugccccuagauuugcuuucgcccugucccggggguuuggaagcggcaucauuaccucuaacgcucccauggacgaaugugaugccaagugccagacaccgcaaggcgcgaucaauuccagccuuccuuuccagaacgugcaccccgucaccaucggggaguguccuaaauacgugcgcucugccaagcugagaauggcuaccggacuccggaauauucccagcauccagucccgcggccuguuuggggccauugcuggauucaucgaaggcggguggacaggaaugguugacggcugguauggcuaccaucaccagaacgagcaagggucuggauacgccgccgaucagaaaagcacgcagaaugcuauuaacggcaucaccaauaaggugaacuccgucaucgaaaagaugaauacacaguuuaccgcgguggggaaagaguucagcaaacuggagagacggauggaaaaccucaauaagaagguugacgauggauuccuggacauuuggacauauaacgccgagcuucuggugcuccuggaaaacgagcgcacccuugacuuucacgauucuaaugucaaaaaccuguacgaaaaggugaaaucccaacucaagaauaacgcuaaagagaucggcaaugggugcuucgaguuuuaucauaaguguaacgacgaaugcauggagagcgucaagaauggcacguacgauuaucccaaauacucugaagaguccaagcugaacagagagaaaauugacggagugaagcuggaaagcaugggcguuuaucagauccucgccauuuacuccacaguggccucuagccugguccuucuggugucccucggggcuaucucuuucuggaugugcagcaauggaucccugcagugucggaucugcauuuga

SEQ ID NO: 185153 - RNA, 1698 nt, Artificial Sequence
  derived and/or modified sequence opt5 from hemagglutinin__InfluenzaA__ABW81519
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcucaugugagcgucguuuccucucacuauagccggcgcuucacccccgagauugccaaaagaccuaaggugcgggaccaggaagggcgcaucaauuacuauuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaucccgucaccaucggggaguguccuaaauacgugcgcucugccaagcugagaauggcuaccggacuccggaauauucccagcauccagucccgcggccuguucggggccauugcuggauuuaucgaaggcggguggacaggaaugguugacggcugguauggcuaccaccaccagaacgagcaagggucuggauaugccgccgaucagaaaagcacgcagaaugcuauuaacggcaucaccaauaaggugaacuccgucaucgaaaagaugaauacacaguucaccgcgguggggaaagaguucagcaaacuggagagacggauggaaaaccucaauaagaagguugacgauggauuucuggacauuuggacauacaacgccgagcuucuggugcuccuggaaaacgagcgcacccuugacuuccaugauucuaaugucaaaaaccuguacgaaaaggugaaaucccaacucaagaauaacgcuaaagagaucggcaaugggugcuuugaguucuaucacaaguguaacgacgaaugcauggagagcgucaagaauggcacguacgauuaucccaaauacucugaagaguccaagcugaacagagagaaaauugacggagugaagcuggaaagcaugggcguuuaucagauccucgccauuuacuccacaguggccucuagccugguccuucuggugucccucggggcuaucucuuuuuggaugugcagcaauggaucccugcagugucggaucugcauuuga

SEQ ID NO: 185154 - RNA, 1698 nt, Artificial Sequence
  derived and/or modified sequence opt5 from hemagglutinin__InfluenzaA__ABW81520
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcagcuguuccguugcuggguggauucucggaaauccugagugcgaacugcuuaucucuaaagagagcugguccuacauuguggaaaccccgaaccccgagaauggcacguguuauccuggguacuuugccgacuaugaggaacugagagagcaacucucuagcgucuccagcuucgaacgguuugagaucuuccccaaggagucuuccuggccuaaccauaccgugacaggaguuagcgccucuugcucccacaauggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaaugcucccauggacgaaugugaugccaagugccagacaccgcaaggcgcgaucaacagcucucuuccuuuucagaaugugcaccccgucaccaucggggaguguccuaaauaugugcgcagcgccaagcugagaauggcuaccggacuccggaacauucccuccauccagucucgcggccuguucggggccauugcuggauuuaucgaaggcggguggacaggaaugguugacggcugguacggcuaucaucaccagaaugagcaagggagcggauacgccgccgaucagaaauccacgcagaacgcuauuaauggcaucaccaacaaggugaauagcgucaucgaaaagaugaacacacaguucaccgcgguggggaaagaguucucuaaacuggagagacggauggaaaaucucaacaagaagguugacgauggauuucuggacauuuggacauacaaugccgagcuucuggugcuccuggaaaacgagcgcacccuugacuuccacgauuccaacgucaaaaaucuguaugaaaaggugaaaagccaacucaagaacaaugcuaaagagaucggcaacgggugcuuugaguucuaccauaaguguaaugacgaaugcauggagucugucaagaacggcacguaugauuaccccaaauauuccgaagagagcaagcugaauagagagaaaauugacggagugaagcuggaauccaugggcguuuaccagauccucgccauuuauucuacaguggccagcucccugguccuucuggugucucucggggcuaucagcuuuuggaugugcuccaacggaagccugcagugucggaucugcauuuga

SEQ ID NO: 185155 - RNA, 1698 nt, Artificial Sequence
  derived and/or modified sequence opt5 from hemagglutinin__InfluenzaA__ABW81521
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuucuuccaacgcucccauggacgaaugugaugccaagugccagaccccgcaaggcgcgaucaauagcucucuuccuuuucagaacgugcaccccgucacaaucggggaguguccuaaauaugugcgcagcgccaagcugagaauggcuaccggacuccggaauauucccuccauccagucucgcggccuguucggggccauugcuggauuuaucgaaggcggguggaccggaaugguugacggcugguacggcuaucaucaccagaacgagcaagggagcggauacgccgccgaucagaaauccacacagaaugcuauuaacggcaucacgaauaaggugaacagcgucaucgaaaagaugaauacccaguucacagcgguggggaaagaguucucuaaacuggagagacggauggaaaaccucaauaagaagguugacgauggauuucuggacauuuggaccuacaacgccgagcuucuggugcuccuggaaaacgagcgcacacuugacuuccacgauuccaaugucaaaaaccuguaugaaaaggugaaaagccaacucaagaauaacgcuaaagagaucggcaaugggugcuuugaguucuaccauaaguguaacgacgaaugcauggagucugucaagaauggcaccuaugauuaccccaaauauuccgaagagagcaagcugaacagagagaaaauugacggagugaagcuggaauccaugggcguuuaccagauccucgccauuuauucuacgguggccagcucccugguccuucuggugucucucggggcuaucagcuuuuggaugugcuccaauggaagccugcagugucggaucugcauuuga

SEQ ID NO: 185156 - RNA, 1698 nt, Artificial Sequence; identical to SEQ ID NO: 184409
  derived and/or modified sequence opt5 from hemagglutinin__InfluenzaA__ABW81522

SEQ ID NO: 185157 - RNA, 1698 nt, Artificial Sequence; identical to SEQ ID NO: 184409
  derived and/or modified sequence opt5 from hemagglutinin__InfluenzaA__ABW81523

SEQ ID NO: 185158 - RNA, 1698 nt, Artificial Sequence
  derived and/or modified sequence opt5 from hemagglutinin__InfluenzaA__ABW81524
augaaggugaaacugcucguccugcuuugcaccuucacagccacguacgcugacaccaucuguauuggcuaucacgccaacaauagcacagauaccaucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucugccaagcugagaauggcuaccggacuccggaauauccccagcauucagucccgcggccuguucggggccaucgcuggauuuauugaaggcggguggacaggaaugguggacggcugguacggcuaucaucaccagaacgagcaagggucuggauacgccgccgaucagaaaagcacgcagaaugcuaucaacggcaucaccaauaagguuaacuccgugauugaaaagaugaauacacaguucaccgcggucgggaaagaguucagcaaacuggagagacggauggaaaaccucaauaagaagguggacgauggauuucuggacaucuggacauacaacgccgagcuucugguucuccuggaaaacgagcgcacccuugacuuccacgauucuaaugugaaaaaccuguaugaaaaggucaaaucccaacucaagaauaacgcuaaagagauuggcaaugggugcuuugaguucuaccauaaguguaacgacgaaugcauggagagcgugaagaauggcacguaugauuaccccaaauauucugaagaguccaagcugaacagagagaaaaucgacggagucaagcuggaaagcaugggcguguaccagauucucgccaucuauuccacaguugccucuagccuggugcuucuggucucccucggggcuaucucuuuuuggaugugcagcaauggaucccugcagugucggauuugcaucuga

SEQ ID NO: 185159 - RNA, 1698 nt, Artificial Sequence
  derived and/or modified sequence opt5 from hemagglutinin__InfluenzaA__ABW81526
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagaaggcccuguaccauaccgaaaacgcuuacgugagcgucguuuccucucacuauagccgcaaauucacacccgagauugccaagagaccuaaagugcgggaccaggaagggcgcaucaauuacuauuggacccuucuggagcccggagauacgauuaucuuugaggcgaacggcaaucucauugccccuagauacgcuuucgcccugucccggggguuuggaagcggcaucauuaacucuaaugcucccaugggcaagugugacgccaaaugccagacaccgcaaggggcgaucaacuccagccuuccuuuccagaaugugcaucccgucaccaucggagaauguccuaaguaugugcgcucugccaaacugagaaugguuacaggccuccggaacauucccagcauccagucccgcgggcuguuuggagcuauugccggcuucaucgaagggggauggaccggcaugguggauggcugguacggguaucaccaccagaaugaacaaggaucuggcuacgcugccgaccaaaagagcacccagaacgccauuaaugggaucacaaacaaggucaauuccgugaucgagaaaaugaacacgcaguuuaccgcuguuggaaaggaguucaauaaacuggagagacggauggagaaccucaacaagaaaguggaugacggcuucauugauaucuggacauacaaugcggaacugcuuguccugcucgagaacgaacgcacccuggaccuucaugacagcaaugugaagaaccuguaugagaaggucaaaucucagcucaagaauaacgccaaagaaauugggaauggcugcuuugaguucuaccacaaguguaacgaugagugcauggaauccgugaaaaauggaacauaugacuaccccaaguauagcgaggaaucuaagcugaacagagagaaaaucgauggcguuaagcuggaguccauggggguguaccagauucucgcuaucuauagcaccgucgccuccucucuggugcuucugguuagccucggagccaucuccuuuuggaugugcucuaauggcagccugcagugucggauuugcaucuga

SEQ ID NO: 185160 - RNA, 1698 nt, Artificial Sequence
  derived and/or modified sequence opt5 from hemagglutinin__InfluenzaA__ABW81527
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcggaaucaggaagggcgcaucaacuauuacuggacgcuucuggagcccggagacacaauuaucuuugaggcgaauggcaaccucauugccccuagauucgcuuuugcccugucccggggguucggaagcggcaucauuaccucuaaugcucccauggaugaaugugacgccaagugccagacaccgcaaggcgcgaucaacuccagccuuccuuuucagaaugugcaccccgucaccaucggggaguguccuaaauaugugcgcucugccaagcugagaauggcuaccggacuccggaacauucccagcauccagucccgcggccuguucggggccauugcuggauuuaucgaaggcggguggacaggaaugguugauggcugguacggcuaucaucaccagaaugagcaagggucuggauacgccgccgaccagaaaagcacgcagaacgcuauuaauggcaucaccaacaaggucaauuccgugaucgaaaagaugaacacacaguucaccgcgguggggaaagaguucagcaaacuggagagacggauggaaaaucucaacaagaagguugaugacggauuucuggauauuuggacauacaacgccgagcuucuggugcuccuggaaaaugagcgcacccuugacuuccacgacucuaacgucaaaaaucuguaugaaaaggugaaaucccaacucaagaacaaugcuaaagagaucggcaacgggugcuuugaguucuaccauaaguguaaugaugaaugcauggagagcgucaagaacggcacguaugacuaccccaaauauucugaagaguccaagcugaauagagagaaaauugauggagugaagcuggaaagcaugggcguuuaccagauccucgccauuuauuccacaguggccucuagccugguccuucuggugucccucggggcuaucucuuuuuggaugugcagcaacggaucccugcagugucggaucugcauuuga

SEQ ID NO: 185161 - RNA, 1698 nt, Artificial Sequence
  derived and/or modified sequence opt5 from hemagglutinin__InfluenzaA__ABW81528
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccugggcauuuugccgacuacgaggaacugagagagcaacucuccucugucagcuccuucgaacgguuugagaucuuccccaaggagagcucuuggccuaaucacaccgugacaggaguuuccgccagcugcucucauaacggcaaguccagcuuuuaucgcaaucugcuuuggcugaccggcaaaaacgggcucuaccccaaucugucuaaguccuaugcuaacaauaaagaaaaggaggugcugguccucuggggaauccaccacccuccgaacauuggcgaucagagagcccuguaccauacagaaaacgcuuacgugagcguggucuccucucacuauagccggcgcuucacccccgagaucgccaaaagaccuaagguucgggaccaggaagggcgcauuaauuacuauuggacgcuucuggagcccagagauacaaucauuuuugaggcgaacggaaaucucaucgccccucgguucgcuuuugcccugucccgcggcuucgggagcggaauuaucaccucuaacgcucccauggacgaaugugaugccaagugccagacaccgcaaggcgcgaucaauuccagccuuccuuuucagaacgugcaucccgugaccauuggcgaguguccuaaauacgucagaucugccaagcugcggauggugaccgggcuccgcaauauccccagcauucaguccagaggacuguucggcgcuaucgccggguuuauugaaggaggcuggacagggaugguugacggaugguauggcuaccaccaccagaacgagcaaggcucuggguaugcugccgaucagaaaagcacgcagaaugccaucaacggaaucaccaauaaggugaacuccgucauugaaaagaugaauacacaguucaccgcugugggcaaagaguucaacaaacuggagcggcgcauggaaaaucucaacaagaagguugacgauggguuucuggacaucuggacauacaacgcggagcuucuggugcuccuggaaaaugagagaacccuugacuuccaugauagcaacgucaaaaaucuguacgaaaaggugaaaucucaacucaagaacaaugccaaagagauuggaaacggcugcuuugaguucuaucacaaguguaaugacgaaugcauggaguccgucaagaacgggacguacgauuaucccaaauacagcgaagagucuaagcugaaucgggagaaaaucgacggcgugaagcuggaauccaugggaguuuaucagauucucgcuaucuacagcacaguggccuccucucugguccuucuggugagccucggcgccaucuccuuuuggaugugcucuaacgggagccugcaguguagaauuugcaucuga

SEQ ID NO: 185162 - RNA, 1698 nt, Artificial Sequence
  derived and/or modified sequence opt5 from hemagglutinin__InfluenzaA__ABW81529
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccagagagucuuggagcuacaucguugaaaccccgaaucccgagaacggcacguguuauccuggguacuuugccgacuaugaggaacugcgggagcaacucuccucugugagcuccuucgaacgcuuugagaucuuccccaaagagagcucuuggccuaaucauaccgucacaggaguguccgccagcugcucucacaacggcaaguccagcuuuuacagaaaucugcuuuggcugaccggcaagaacgggcucuaucccaaucugucuaaauccuacgcuaacaauaaggaaaaagagguucugauucucuggggagugcaucacccuccgaacauccgggaucagaugacacuguaccacaccgaaaacgccuaugucagcgugguguccucucauuacagccgcagauucacgcccgagauuacaaagcggccuaaaguccgcgaccaggaaggcagaaucaauuauuacuggacccuucuggagcccggggauacaauuaucuuugaggcuaacggaaaucucauugccccuugguaugcguucgcccugucccggggcuuugggagcggaaucaucaccucuaacgcucccauggacgaaugugaugccaagugccagaccccgaagggcgcuauuaauuccagccuuccuuuccaaaacguucaccccgugacaaucggcgaguguccuaaauacgugcgcucugccaagcugagaauggucacggggcuccggaauauucccagcauccagucccgcggacuguuuggcgcgauugccggguucaucgaaggaggcuggaccgggaugguggacggaugguauggcuaccaucaccagaacgagcagggcucuggguacgcugccgaucagaaaagcacacaaaaugcuaucaacggaauuaccaauaagguuaacuccgugaucgaaaagaugaauacacaguuuaccgccgucggcaaagaguucaacaaacuggagagacggauggaaaaucucaacaagaagguggacgauggguuccuggacauuuggacguauaacgccgagcuucugguucuccuggaaaaugagcgcacacuugacuuucacgauagcaacgugaaaaaucuguacgaaaaggucaaaucucagcucaagaacaaugcuaaagagaucggaaacggcugcuucgaguuuuaucauaaguguaauaacgaaugcauggaguccgugaagaaugggaccuacgacuaucccaaauacagcgaagagucuaagcugaacagagagaaaauugauggcgucaagcuggaauccaugggaguguaucaaauccucgcgaucuacagcaccguugccuccucucuggugcuucuggucagccucggcgcuauuuccuucuggaugugcucuaaugggagccugcagugucggaucugcauuuga

SEQ ID NO: 185163 - RNA, 1698 nt, Artificial Sequence
  derived and/or modified sequence opt5 from hemagglutinin__InfluenzaA__ABW81530
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaaucauacggucaccggaguguccgcuagcugcucucacaacggcaaguccagcuuuuaccgcaaucugcuuuggcugacaggcaaaaacgggcucuaucccaaucugucuaaguccuacgccaacaauaaagaaaaggagguucugauucucuggggagugcaucacccuccgaacaucggcgaucagagaacccuguaccacacagaaaacgcuuaugucagcgugguguccucucauuacagccggcgcuucacccccgagauuacgaaaagaccuaagguccgggaccaggaagggcgcaucaauuauuacuggacacuucuggagcccggagauaccauuaucuuugaggccaacggcaaucucauugcgccuugguaugccuucgcucuguccagaggguuuggaagcggcaucaucacaucuaacgcccccauggacgaaugugaugcuaagugccagaccccgcaaggcgccauuaauuccagccuuccuuuccagaacguucaccccgugaccaucggggaguguccuaaauacgugcggucugcgaagcugcgcauggucacaggacucagaaauauucccagcauccagucccggggccuguuuggggccauugcuggauucaucgaaggcggguggacgggaaugguggacggcugguauggcuaccaucaccagaacgagcaagggucuggauacgccgcugaucagaaaagcacccagaaugccaucaaccgcauuacaaauaagguuaacuccgugaucgaaaagaugaauacccaguuuacagccgucggcaaagaguucaacaaacuggagagacggauggaaaaucucaacaagaagguggacgauggguuccuggacauuuggaccuauaacgcugagcuucugguucuccuggaaaaugagcgcacgcuugacuuucacgauagcaacgugaaaaaucuguacgaaaaggucaaaucucaacucaagaacaaugcgaaagagaucggaaacggcugcuucgaguuuuaucauaaguguaauaacgaaugcauggaguccgugaagaaugggacauacgacuaucccaaauacagcgaagagucuaagcugaacagagagaaaauugauggcgucaagcuggacuccaugggaguguaucagauccucgccaucuacagcaccguugcuuccucucuggugcuucuggucagccucggcgccauuuccuucuggaugugcucuaaugggagccugcagugucggaucugcauuuga

SEQ ID NO: 185164 - RNA, 1698 nt, Artificial Sequence; identical to SEQ ID NO: 183350
  derived and/or modified sequence opt5 from hemagglutinin__InfluenzaA__ABW81531

SEQ ID NO: 185165 - RNA, 1698 nt, Artificial Sequence
  derived and/or modified sequence opt5 from hemagglutinin__InfluenzaA__ABW81532
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuugguacuuugccgacuaugaggaacugagagagcaacucuccucugugagcuccuucgaacgguuugagaucuuccccaaggagagcucuuggccuaaucauacggucaccgggguguccgcuagcugcucucacaacggaaaguccagcuuuuaccgcaaucugcuuuggcugacaggcaaaaacggccucuaucccaaucugucuaaguccuacgccaacaauaaagaaaaggagguucugauucucuggggagugcaucacccuccgaacaucgggaaccagagaacccuguaccacacagaaaaugcuuaugucagcgugguguccucucauuacagccggcgcuucacccccgagauuacgaaaagaccuaagguccgggaucaggaaggccgcaucaacuauuacuggacacuucuggagcccggggacaccauuaucuuugaggccaauggaaaccucauugcgccuugguaugccuucgcucuguccagaggcuuugggagcggaaucaucacaucuaaugcccccauggaugaaugugacgcuaagugccagaccccgcaaggcgccauuaacuccagccuuccuuuccagaauguucaccccgugaccaucggcgaguguccuaaauacgugcggucugcgaagcugcgcauggucacagggcucagaaacauucccagcauccagucccggggacuguuuggcgccauugcuggguucaucgaaggaggcuggacggggaugguggauggaugguauggcuaccaucaccagaaugagcaaggcucuggguacgccgcugaccagaaaagcacccagaacgccaucaauggaauuacaaacaagguuaauuccgugaucgaaaagaugaacacccaguuuacagccgucggcaaagaguucaauaaacuggagcgcagaauggaaaaccucaacaagaagguggaugacggguuccuggauauuuggaccuauaaugcugagcuucugguucuccuggaaaacgagcggacgcuugacuuucacgacagcaaugugaaaaaccuguacgaaaaggucaaaucucaacucaagaauaacgcgaaagagaucggaaauggcugcuucgaguuuuaucauaaguguaacaaugaaugcauggaguccgugaagaacgggacauacgauuaucccaaauacagcgaagagucuaagcugaaucgcgagaaaauugacggcgucaagcuggauuccaugggaguguaucagauccucgccaucuacagcaccguugcuuccucucuggugcuucuggucagccucggcgccauuuccuucuggaugugcucuaacgggagccugcaguguagaaucugcauuuga

SEQ ID NO: 185166 - RNA, 1698 nt, Artificial Sequence; identical to SEQ ID NO: 184980
  derived and/or modified sequence opt5 from hemagglutinin__InfluenzaA__ABW86321

SEQ ID NO: 185167 - RNA, 1698 nt, Artificial Sequence; identical to SEQ ID NO: 184945
  derived and/or modified sequence opt5 from hemagglutinin__InfluenzaA__ABW86332

SEQ ID NO: 185168 - RNA, 1698 nt, Artificial Sequence; identical to SEQ ID NO: 184934
  derived and/or modified sequence opt5 from hemagglutinin__InfluenzaA__ABW86343

SEQ ID NO: 185169 - RNA, 1698 nt, Artificial Sequence; identical to SEQ ID NO: 184938
  derived and/or modified sequence opt5 from hemagglutinin__InfluenzaA__ABW86354

SEQ ID NO: 185170 - RNA, 1698 nt, Artificial Sequence; identical to SEQ ID NO: 184938
  derived and/or modified sequence opt5 from hemagglutinin__InfluenzaA__ABW86365

SEQ ID NO: 185171 - RNA, 1698 nt, Artificial Sequence; identical to SEQ ID NO: 184954
  derived and/or modified sequence opt5 from hemagglutinin__InfluenzaA__ABW86376

SEQ ID NO: 185172 - RNA, 1698 nt, Artificial Sequence; identical to SEQ ID NO: 184938
  derived and/or modified sequence opt5 from hemagglutinin__InfluenzaA__ABW86387

SEQ ID NO: 185173 - RNA, 1698 nt, Artificial Sequence; identical to SEQ ID NO: 184934
  derived and/or modified sequence opt5 from hemagglutinin__InfluenzaA__ABW86409

SEQ ID NO: 185174 - RNA, 1698 nt, Artificial Sequence; identical to SEQ ID NO: 184934
  derived and/or modified sequence opt5 from hemagglutinin__InfluenzaA__ABW86431

SEQ ID NO: 185175 - RNA, 1698 nt, Artificial Sequence; identical to SEQ ID NO: 184938
  derived and/or modified sequence opt5 from hemagglutinin__InfluenzaA__ABW86442

SEQ ID NO: 185176 - RNA, 1698 nt, Artificial Sequence; identical to SEQ ID NO: 184954
  derived and/or modified sequence opt5 from hemagglutinin__InfluenzaA__ABW86453

SEQ ID NO: 185177 - RNA, 1698 nt, Artificial Sequence; identical to SEQ ID NO: 184938
  derived and/or modified sequence opt5 from hemagglutinin__InfluenzaA__ABW86464

SEQ ID NO: 185178 - RNA, 1698 nt, Artificial Sequence; identical to SEQ ID NO: 184954
  derived and/or modified sequence opt5 from hemagglutinin__InfluenzaA__ABW86475

SEQ ID NO: 185179 - RNA, 1698 nt, Artificial Sequence; identical to SEQ ID NO: 184934
  derived and/or modified sequence opt5 from hemagglutinin__InfluenzaA__ABW86486

SEQ ID NO: 185180 - RNA, 1698 nt, Artificial Sequence; identical to SEQ ID NO: 184980
  derived and/or modified sequence opt5 from hemagglutinin__InfluenzaA__ABW86497

SEQ ID NO: 185181 - RNA, 1698 nt, Artificial Sequence; identical to SEQ ID NO: 184938
  derived and/or modified sequence opt5 from hemagglutinin__InfluenzaA__ABW86508

SEQ ID NO: 185182 - RNA, 1698 nt, Artificial Sequence
  derived and/or modified sequence opt5 from hemagglutinin__InfluenzaA__ABW86519
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcggaaucaggaagggcgcaucaacuauuacuggacgcuucuggagcccggagacacaauuaucuuugaggcgaauggcaaccucauugccccuagauucgcuuuugcccugucccggggguucggaagcggcaucauuaccucuaaugcucccaugggcgaaugugaugccaagugccagacaccgcaaggggcgaucaacuccagccuuccuuuucagaaugugcaccccgucaccaucggagaguguccuaaauaugugcgcucugccaagcugagaaugguuaccggccuccggaacauucccagcauccagucccgcgggcuguucggagcuauugccggcuuuaucgaagggggauggacaggcaugguggacggcugguacggguaucaucaccagaaugagcaaggaucuggcuacgcugccgaucagaaaagcacgcagaacgccauuaaugggaucaccaacaaggucaauuccgugaucgaaaagaugaacacacaguucaccgcuguuggaaaagaguucaauaaacuggagagacggauggaaaaccucaacaagaagguggacgauggcuuucuggacauuuggacauacaaugcggagcuucugguccuccuggaaaacgagcgcacccuugauuuccacgacagcaaugugaaaaaccuguaugaaaaggucaaaucucaacucaagaauaacgccaaagagaucgggaauggcugcuuugaguucuaccauaaguguaacgacgaaugcauggaguccgugaagaauggaacguaugauuaccccaaauauagcgaagagucuaagcugaacagagagaaaauugacggcguuaagcuggaauccauggggguguaccagauccucgcuauuuauagcacagucgccuccucucuggugcuucugguuagccucggagccaucuccuuuuggaugugcucuaauggcagccugcagugucggaucugcauuuga

SEQ ID NO: 185183 - RNA, 1698 nt, Artificial Sequence; identical to SEQ ID NO: 184934
  derived and/or modified sequence opt5 from hemagglutinin__InfluenzaA__ABW86530

SEQ ID NO: 185184 - RNA, 1698 nt, Artificial Sequence
  derived and/or modified sequence opt5 from hemagglutinin__InfluenzaA__ABW86541
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggcugaaucauaccgugacaggaguuuccgccagcugcucucacaacggcaaguccagcuuuuaccgcaaucuucuguggcucaccggcaaaaacgggcuguauccuaaucugucuaaguccuacgcuaacaauaaagaaaaggaggugcucguccuguggggagugcaucaucccccuaacaucggcgaucagagagcccuuuaccacacagaaaacgcuuaugugagcgucguuuccucucacuacagccggcgcuucaccccggagauugccaaaagacccaaggugcgggaccaggaagggcgcaucaauuauuacuggacgcugcucgagccuggagauacaauuaucuuugaggcgaacggcaaucugauugcccccagauucgcuuuugcccuuucccggggguucggaagcggcaucauuaccucuaacgcuccuaugggcgaaugugacgccaagugccagacaccccaaggggcgaucaauuccagccugccguuucagaacgugcacccugucaccaucggagagugucccaaauaugugcgcucugccaagcucagaaugguuaccggccugcggaauauuccuagcauccagucccgcgggcuguucggagcuauugccggcuuuaucgaagggggauggacaggcaugguggauggcugguacggguaucaucaccagaacgagcaaggaucuggcuacgcugccgaccagaaaagcacgcagaaugccauuaacgggaucaccaauaaggucaacuccgugaucgaaaagaugaauacacaguucaccgcuguuggaaaagaguucaacaaacucgagagacggauggaaaaucugaacaagaagguggaugacggcuuucuugauauuuggacauacaacgcggagcugcucguccugcuugaaaaugagcgcacccuggacuuccacgacagcaacgugaaaaaucucuaugaaaaggucaaaucucaacugaagaacaaugccaaagagaucgggaacggcugcuuugaguucuaccauaaguguaaugaugaaugcauggaguccgugaagaacggaacguaugacuaccccaaauauagcgaagagucuaagcugaauagagagaaaauugauggcguuaagcucgaauccauggggguguaccagauccuggcuauuuauagcacagucgccuccucucuugugcugcucguuagccugggagccaucuccuuuuggaugugcucuaacggcagccugcagugucggaucugcauuuga

SEQ ID NO: 185185 - RNA, 1698 nt, Artificial Sequence; identical to SEQ ID NO: 184934
  derived and/or modified sequence opt5 from hemagglutinin__InfluenzaA__ABW86552

SEQ ID NO: 185186 - RNA, 1701 nt, Artificial Sequence
  derived and/or modified sequence opt5 from hemagglutinin__InfluenzaA__ABW86563
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaagggcguggaacucaaauccggacacaaggauuggauccuguggauuagcuuugccaucucuugcuuccuucugugugucgcccuccugggcuuuaucaugugggcuugccagaaagggaacauucgguguaauaucugcauuuga

SEQ ID NO: 185187 - RNA, 1698 nt, Artificial Sequence; identical to SEQ ID NO: 184971
  derived and/or modified sequence opt5 from hemagglutinin__InfluenzaA__ABW86606

SEQ ID NO: 185188 - RNA, 1701 nt, Artificial Sequence; identical to SEQ ID NO: 183945
  derived and/or modified sequence opt5 from hemagglutinin__InfluenzaA__ABW91185

SEQ ID NO: 185189 - RNA, 1701 nt, Artificial Sequence
  derived and/or modified sequence opt5 from hemagglutinin__InfluenzaA__ABW91196
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcaauucuccgcaccagauccuugacggggaaaacuguacccugauugaugcccuccugggagacccccagugcgauggcuuucaaaauaaaaagugggaccuguucgucgagagaagcaaagccuauuccaacuguuacccuuaugaugugcccgacuacgcuucucuccggagccugguugccuccagcgggacgcuugaauuuaauaacgagucuuucaauuggaccggagugacacagaacggcaccuccagcgcuugcauccgcagaucuaauaacuccuuuuucagccggcugaauuggcucacacaucugaaguuuaaguauccugcccuuaacgucaccaugcccaacaaugagaaauucgauaagcuguacauuuggggcgugcaccauccugggacggacaacgaucagaucuuucucuaugcgcaggccucuggacgcauuacaguuuccaccaaaagaagccaacagacagugaucccgaauauuggcucccggccccgcgucagaaacaucccuucucggaucagcauuuacuggaccaucgugaagcccggggacauucugcugaucaauuccaccggaaaccucauugcuccucgcggcuacuucaaaaucagaagcgggaagucuuccaucaugcggagcgaugcccccauuggaaaguguaauucugaaugcaucacaccgaacggcagcauuccuaaugacaaacccuuucagaacgugaaucgcaucacguauggcgcuuguccuagauacgucaagcagaacacccugaaacuugccacagggaugcggaauguucccgagaagcaaacccgcggaauuuucggcgcgaucgccggguuuaucgaaaacggaugggagggcaugguggacgggugguauggauucagacaccaaaauuccgagggcauuggccaggcugccgaucugaaaucuacacaggcugccaucgaccagauuaacgggaagcucaaccggcugaucggaaaaaccaaugaaaaguuccaccagauugagaaggaauuuagcgagguggaaggcagaauccaggaucuugagaaauacgucgaggacacgaagauugaucugugguccuauaacgccgaacuccugguggcucuggagaaucaacauacaaucgaccucaccgauagcgaaaugaacaaacuguucgagaagaccaaaaagcagcuucgcgaaaaugcggaggacauggggaacggaugcuuuaagaucuaccacaaaugugauaaugccugcauuggcucuauccggaacgggacauaugaccaugauguuuacagagacgaggcucugaauaaccgcuuccagauuaagggcguggaacucaaauccggauacaaggacuggauccuguggauuagcuuugccaucucuugcuuccuucugugugucgcccuccugggcuuuaucaugugggcuugccagaaagggaauauucgguguaacaucugcauuuga

SEQ ID NO: 185190 - RNA, 1701 nt, Artificial Sequence; identical to SEQ ID NO: 185189
  derived and/or modified sequence opt5 from hemagglutinin__InfluenzaA__ABW91207

SEQ ID NO: 185191 - RNA, 1698 nt, Artificial Sequence; identical to SEQ ID NO: 184934
  derived and/or modified sequence opt5 from hemagglutinin__InfluenzaA__ABW91218

SEQ ID NO: 185192 - RNA, 1701 nt, Artificial Sequence; identical to SEQ ID NO: 184952
  derived and/or modified sequence opt5 from hemagglutinin__InfluenzaA__ABW91240

SEQ ID NO: 185193 - RNA, 1701 nt, Artificial Sequence
  derived and/or modified sequence opt5 from hemagglutinin__InfluenzaA__ABW91251
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaaguccggggauauucugcugaucaacagcaccggaaaucucauugcuccccgcggcuacuucaaaaucagaucugggaaguccagcaucaugcggucugacgccccuauuggaaaguguaacagcgaaugcaucacacccaauggcuccauuccgaacgacaaaccuuuucagaaugugaaccgcaucacguauggcgcuugucccagauacgucaagcagaauacccugaaacuugccacagggaugcggaacguuccugagaagcaaacccgcggaauuuucggcgcgaucgccggguuuaucgaaaauggaugggagggcaugguggaugggugguauggauucagacaccagaacucugagggcauuggccaggcugccgaccugaaaagcacacaagcugccaucgaucagauuaaugggaagcucaaccggcugaucggaaaaaccaacgaaaaguuccaccagauugagaaggaauuuuccgagguggaaggcagaauccaggaccuugagaaauacgucgaggauacgaagauugaccuguggagcuauaaugccgaacuccugguggcucuggagaaccaacauacaaucgaucucaccgacucugaaaugaauaaacuguucgagaagaccaaaaagcagcuucgcgaaaacgcggaggauauggggaauggaugcuuuaagaucuaccacaaaugugacaacgccugcauuggcuccauccggaaugggacauaugaucaugacguuuacagagacgaggcucugaacaaucgcuuccagauuaagggcguggaacucaaaagcggauacaaggauuggauccuguggauuucuuuugccaucuccugcuuccuucugugugucgcccuccugggcuuuaucaugugggcuugccagaaagggaacauucgguguaauaucugcauuuga

SEQ ID NO: 185194 - RNA, 1701 nt, Artificial Sequence; identical to SEQ ID NO: 184952
  derived and/or modified sequence opt5 from hemagglutinin__InfluenzaA__ABW91262

SEQ ID NO: 185195 - RNA, 1698 nt, Artificial Sequence; identical to SEQ ID NO: 184969
  derived and/or modified sequence opt5 from hemagglutinin__InfluenzaA__ABW91273

SEQ ID NO: 185196 - RNA, 1698 nt, Artificial Sequence
  derived and/or modified sequence opt5 from hemagglutinin__InfluenzaA__ABW91284
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcgaucagagagcccuguaccauacagagaacgcuuacgugagcguggucuccucucacuauagccggaaauucacccccgaaauugccaagcgcccuaagguuagagaccaggaggggcggaucaauuacuauuggacgcuucuggagcccggagauacaauuaucuuugaagcgaacggcaaucucauugccccucgcuacgcuuucgcccuguccagaggguuuggaagcggcaucauuaacucuaaugcuuccaugggcgagugugacgccaaaugccagacaccccaaggggcgaucaacagcucucuuccguuccagaaugugcauccugugaccaucggagaaugucccaaguauguccggagcgccaaacugcgcauggugaccggccucagaaacauuccuuccauccagucucgggggcuguuuggagcuauugccggcuucaucgaagggggauggaccggcaugguugauggcugguacggguaucaccaccagaaugagcaaggaagcggcuacgcugccgaccagaaguccacacagaacgccauuaaugggaucacgaacaaagugaauagcgucaucgagaagaugaacacccaguuuacagcugugggaaaagaguucaauaagcuggaacgcagaauggagaaccucaacaagaaaguugaugacggcuucauugauaucuggaccuacaaugcggaacugcuugugcugcucgagaacgaacggacacuggacuuucaugacucuaaugucaagaaccuuuaugagaaagugaagucccaacugaaaaauaacgccaaggagauugggaauggcugcuucgaauuuuaccacaaguguaacgaugagugcauggaaagcgucaaaaauggaaccuaugacuaccccaaguauucugaggaguccaaacucaaccgcgaaaagaucgauggcgugaaacuggagagcauggggguuuaccagauucuggcuaucuauuccacgguggccucuagccucguccugcuugugucccugggagccaucucuuucuggaugugcagcaauggcucccuccaguguagaauuugcaucuga

SEQ ID NO: 185197 - RNA, 1698 nt, Artificial Sequence; identical to SEQ ID NO: 184969
  derived and/or modified sequence opt5 from hemagglutinin__InfluenzaA__ABW91295

SEQ ID NO: 185198 - RNA, 1698 nt, Artificial Sequence; identical to SEQ ID NO: 184938
  derived and/or modified sequence opt5 from hemagglutinin__InfluenzaA__ABW91306

SEQ ID NO: 185199 - RNA, 1698 nt, Artificial Sequence; identical to SEQ ID NO: 184938
  derived and/or modified sequence opt5 from hemagglutinin__InfluenzaA__ABW91317

SEQ ID NO: 185200 - RNA, 1698 nt, Artificial Sequence
  derived and/or modified sequence opt5 from hemagglutinin__InfluenzaA__ABW91328
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugaaaagaugaauacccaguucacagccguggggaaagaguucaacaaacuggagagacggauggaaaaucucaacaagaagguugacgauggauuucuggacaucuggaccuacaacgcugagcuucuggugcuccuggaaaaugagcgcacgcuugacuuccacgauagcaacgucaaaaaucuguaugaaaaggugagaucucaacucaaaaacaaugcgaaggagauuggcaacgggugcuuugaguucuaccauaaauguaaugacgaaugcauggaguccgucaagaacggcacauaugauuaccccaaguauagcgaagagucuaaacugaaucgggagaagaucgacggagugaaacuggaauccaugggcguuuaccagauucucgccaucuauagcaccguggcuuccucucugguccuucuggugagccucggggccaucuccuuuuggaugugcucuaacggaagccugcaguguagaauuugcaucuga

SEQ ID NO: 185201 - RNA, 1698 nt, Artificial Sequence; identical to SEQ ID NO: 184938
  derived and/or modified sequence opt5 from hemagglutinin__InfluenzaA__ABW91339

SEQ ID NO: 185202 - RNA, 1698 nt, Artificial Sequence; identical to SEQ ID NO: 184938
  derived and/or modified sequence opt5 from hemagglutinin__InfluenzaA__ABW91350

SEQ ID NO: 185203 - RNA, 1698 nt, Artificial Sequence
  derived and/or modified sequence opt5 from hemagglutinin__InfluenzaA__ABW91361
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcgaauccagcuuuuaccgcaaucugcuuuggcugaccggcaagaacgggcucuaucccaaucugucuaaauccuacgcuaacaauaaggagaaagaagugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccggagauacaauuaucuuugaagcgaacggcaaucucauugccccuagauucgcuuuugcccugucccggggguucggaagcggcaucauuaccucuaacgcucccauggacaagugugaugccaagugccagacaccgcaaggcgcgaucaauuccagccuuccuuuucagaacgugcaccccgucaccaucggggaguguccuaaauaugugcgcucuaccaagcugagaaugguuacaggacuccggaauauucccagcauccagacgcgcggccuguucggggccauugcuggauuuaucgaaggcggguggaccggaaugguggacggcugguacggcuaucaucaccagaacgagcaaggguccggauacgccgcugaucagaaaucuacacagaaugccauuaacggcaucaccaauaaggucaacagcgugaucgaaaagaugaauacacaguucaccgccguugggaaagaguucaacaaacuggagagacggauggaaaaucucaacaagaagguggacgauggauuucuggacauuuggacguacaacgcugagcuucugguccuccuggaaaaugagcgcacacuugacuuccacgauuccaacgugaaaaaucuguaugaaaaggucaaaagccaacucaagaacaaugcgaaagagaucggcaacgggugcuuugaguucuaccauaaguguaaugacgaaugcauggagucugugaagaacggcaccuaugauuaccccaaauauuccgaagagagcaagcugaauagagagaaaauugacggaguuaagcuggaaucuaugggcguguaccagauccucgccauuuauuccaccgucgcuagcucccuggugcuucugguuucucucggggccaucagcuuuuggaugugcuccaacggaucucugcagugucggaucugcauuuga

SEQ ID NO: 185204 - RNA, 1698 nt, Artificial Sequence; identical to SEQ ID NO: 184938
  derived and/or modified sequence opt5 from hemagglutinin__InfluenzaA__ABW91372

SEQ ID NO: 185205 - RNA, 1698 nt, Artificial Sequence; identical to SEQ ID NO: 184971
  derived and/or modified sequence opt5 from hemagglutinin__InfluenzaA__ABW91383

SEQ ID NO: 185206 - RNA, 1701 nt, Artificial Sequence; identical to SEQ ID NO: 185011
  derived and/or modified sequence opt5 from hemagglutinin__InfluenzaA__ABW91394

SEQ ID NO: 185207 - RNA, 1698 nt, Artificial Sequence; identical to SEQ ID NO: 184980
  derived and/or modified sequence opt5 from hemagglutinin__InfluenzaA__ABW91405

SEQ ID NO: 185208 - RNA, 1698 nt, Artificial Sequence
  derived and/or modified sequence opt5 from hemagglutinin__InfluenzaA__ABW91416
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagaaagcccuguaccacacagaaaacgcuuaugugagcgucguuuccucucauuacagcagacgguucacccccgagauugccaagcgcccuaaggugagagaccaggaagggcggaucaauuauuacuggacgcuucuggagcccggagauacaauuaucuuugaggcgaacggcaaucucauugccccucgcuucgcuuuugcccuguccagaggguucggaagcggcaucauuaccucuaacgcucccaugggcgaaugugacgccaaaugccagacaccgcaaggggcgaucaauuccagccuuccuuuucagaacgugcaccccgucaccaucggagaguguccuaaguaugugcggucugccaaacugcgcaugguuaccggccucagaaauauucccagcauccagucccgggggcuguucggagcuauugccggcuuuaucgaagggggauggacaggcaugguggauggcugguacggguaucaucaccagaacgagcaaggaucuggcuacgcugccgaccaaaagagcacgcagaaugccauuaacgggaucaccaauaaagucaacuccgugaucgaaaagaugaauacacaguucaccgcuguuggaaaagaguucaacaagcuggagcgcagaauggaaaaucucaacaagaaaguggaugacggcuuucuggauauuuggacauacaacgcggagcuucugguccuccuggaaaaugagcggacccuugacuuccacgacagcaacgugaagaaucuguaugaaaaagucaagucucagcucaaaaacaaugccaaggagaucgggaacggcugcuuugaguucuaccauaaguguaaugaugaaugcauggaguccgugaaaaacggaacguaugacuaccccaaguauagcgaagagucuaaacugaaucgcgagaagauugauggcguuaaacuggaauccauggggguguaccagauccucgcuauuuauagcacagucgccuccucucuggugcuucugguuagccucggagccaucuccuuuuggaugugcucuaacggcagccugcaguguagaaucugcauuuga

SEQ ID NO: 185209 - RNA, 1698 nt, Artificial Sequence; identical to SEQ ID NO: 185083
  derived and/or modified sequence opt5 from hemagglutinin__InfluenzaA__ABW91427

SEQ ID NO: 185210 - RNA, 1701 nt, Artificial Sequence; identical to SEQ ID NO: 184952
  derived and/or modified sequence opt5 from hemagglutinin__InfluenzaA__ABW91438

SEQ ID NO: 185211 - RNA, 1698 nt, Artificial Sequence; identical to SEQ ID NO: 184980
  derived and/or modified sequence opt5 from hemagglutinin__InfluenzaA__ABW91449

SEQ ID NO: 185212 - RNA, 1698 nt, Artificial Sequence; identical to SEQ ID NO: 184980
  derived and/or modified sequence opt5 from hemagglutinin__InfluenzaA__ABW91460

SEQ ID NO: 185213 - RNA, 1698 nt, Artificial Sequence
  derived and/or modified sequence opt5 from hemagglutinin__InfluenzaA__ABW91471
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaguugcgccccugcagcugggcaauuguagcguggcuggguggauccucggaaacccugagugcgaacugcuuauuuccaaagagucuuggagcuacaucgucgaaaccccgaaucccgagaacggcacguguuauccuggguacuuugccgacuaugaggaacugagagagcaacucuccucugugagcuccuucgaacgguuugagauuuuccccaaggagagcucuuggccuaaucauaccguuacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguccuggugcucuggggagugcaucacccuccgaacaucggcgaucagagagcccuguaccacacagaaaacgcuuaugucagcguuguguccucucauuacagccggcgcuucacccccgagaucgccaaaagaccuaaggugcgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgauuaauuccagccuuccuuuucagaacguccaccccgugaccaucggggaguguccuaaauauguucgcucuaccaagcugagaauggugacaggacuccggaauauccccagcauucagucccgcggccuguucggggccaucgcuggauuuauugaaggcggguggacgggaauggucgacggcugguacggcuaucaucaccagaacgagcaagggucuggauacgccgcugaucagaaaagcacccagaaugccaucaacggcauuacaaauaaggugaacuccguuaucgaaaagaugaauacccaguucacagccguggggaaagaguucaacaaacuggagagacggauggaaaaucucaacaagaaggucgacgauggauuucuggacaucuggaccuacaacgcugagcuucuggugcuccuggaaaaugagcgcacgcuugacuuccacgauagcaacgucaaaaaucuguaugaaaaggugaaaucucaacucaagaacaaugcgaaagagauuggcaacgggugcuuugaguucuaccauaaguguaaugacgaaugcauggaguccguuaagaacggcacauaugauuaccccaaauauagcgaagagucuaagcugaauagagagaaaaucgacggagugaagcuggaauccaugggcgucuaccagauucucgccaucuauagcaccguggcuuccucucugguucuucuggugagccucggggccauuuccuuuuggaugugcucuaacggaagccugcagugucggaucugcaucuga

SEQ ID NO: 185214 - RNA, 1698 nt, Artificial Sequence
  derived and/or modified sequence opt5 from hemagglutinin__InfluenzaA__ABW91482
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcagaucuuccuuuuaccggaaucugcuuuggcugaccggcaagaacgggcucuaucccaaucugagccgcucuuacgcuaacaauaaagaaaaggaggugcugguccucuggggagugcaucacccuccgaacaucggcgaucagagagcccuguaccacacagaaaacgcuuauguguccgucguuagcucccauuacucucggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugagccggggguucggauccggcaucauuaccagcaacgcucccauggacgaaugugaugccaaaugccagacaccgcaaggcgcgaucaauucuucccuuccuuuucagaacgugcaccccgucaccaucggggaguguccuaaguaugugcgcagcgccaagcugagaaugguuaccggacuccggaauauucccucuauccagagccgcggccuguucggggcuauugccggauuuaucgaaggcggguggacaggaaugguggacggcugguacggcuaucaucaccagaacgagcaaggguccggauacgcugccgaucagaaaucuacgcagaaugccauuaacggcaucaccaauaaggucaacagcgugaucgaaaagaugaauacacaguucaccgcuguugggaaagaguucaacaaacuggagagacggauggaaaaucucaacaagaaaguggacgauggauuucuggacauuuggacauacaacgcggagcuucugguccuccuggaaaaugagagaacccuugacuuccacgauuccaacgugaagaaucuguaugaaaaggucaaaagccaacucaagaacaaugccaaagagaucggcaacgggugcuuugaguucuaccauaaguguaaugacgaaugcauggagucugugaaaaacggcacguaugauuaccccaaguauuccgaagagagcaagcugaaucgcgagaaaauugacggaguuaagcuggaaucuaugggcguguaccagauccucgcuauuuauuccacagucgccagcucccuggugcuucugguuucucucggggccaucagcuuuuggaugugcuccaacggaucucugcagugucggaucugcauuuga

SEQ ID NO: 185215 - RNA, 1698 nt, Artificial Sequence
  derived and/or modified sequence opt5 from hemagglutinin__InfluenzaA__ABW91493
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugaaaagaugaauacccaguucacagccguggggaaagaguucaacaaacuggagaagagaauggaaaaucucaacaagaaaguugacgauggauuucuggacaucuggaccuacaacgcugagcuucuggugcuccuggaaaaugagcggacgcuugacuuccacgauagcaacgucaagaaucuguaugaaaaagugaagucucaacucaaaaacaaugcgaaggagauuggcaacgggugcuuugaguucuaccauaaguguaaugacgaaugcauggaguccgucaaaaacggcacauaugauuaccccaaguauagcgaagagucuaaacugaaucgcgagaagaucgacggagugaaacuggaauccaugggcguuuaccagauucucgccaucuauagcaccguggcuuccucucugguccuucuggugagccucggggccaucuccuuuuggaugugcucuaacggaagccugcaguguagaauuugcaucuga

SEQ ID NO: 185216 - RNA, 1698 nt, Artificial Sequence; identical to SEQ ID NO: 184954
  derived and/or modified sequence opt5 from hemagglutinin__InfluenzaA__ABW91504

SEQ ID NO: 185217 - RNA, 1698 nt, Artificial Sequence
  derived and/or modified sequence opt5 from hemagglutinin__InfluenzaA__ABW91515
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacguggucgaaaccccgaaucccgagaacggcacguguuauccuggguacuuugccgacuaugaggaacugcgggagcaacucagcuccgugucuagcuucgaacgcuuugagauuuuccccaaggaguccagcuggccuaaucauaccguuacaggagugucugccuccugcagccacaacggcaagucuuccuuuuacagaaaucugcuuuggcugaccggcaaaaacgggcucuaucccaaucugagcaagucuuacgcuaacaauaaagaaaaggagguccuggugcucuggggagugcaucacccuccgaacaucggcgaucagcgggcccuguaccacacagaaaacgcuuaugucuccguugugagcucccauuacucucgcagauucacccccgagaucgccaaacggccuaaggugcgcgaccaggaagggagaauuaauuauuacuggacgcuucuggagcccggagauacaaucauuuuugaggcgaacggcaaucucaucgccccucgguucgcuuuugcccugagccgcggguucggauccggcauuaucaccagcaacgcucccauggacgaaugugaugccaagugccagacaccgcaaggcgcgauuaauucuucccuuccuuuucagaacguccaccccgugaccaucggggaguguccuaaauauguuagaagcgccaagcugcggauggugaccggacuccgcaauauccccucuauucagagcagaggccuguucggggcuaucgccggauuuauugaaggcggguggacaggaauggucgacggcugguacggcuaucaucaccagaacgagcaaggguccggauacgcugccgaucagaaaucuacgcagaaugccaucaacggcauuaccaauaaggugaacagcguuaucgaaaagaugaauacacaguucaccgcuguggggaaagaguucaacaaacuggagcggcgcauggaaaaucucaacaagaaggucgacgauggauuucuggacaucuggacauacaacgcggagcuucuggugcuccuggaaaaugagagaacccuugacuuccacgauuccaacgucaaaaaucuguaugaaaaggugaaaagccaacucaagaacaaugccaaagagauuggcaacgggugcuuugaguucuaccauaaguguaaugacgaaugcauggagucuguuaagaacggcacguaugauuaccccaaauauuccgaagagagcaagcugaaucgggagaaaaucgacggagugaagcuggaaucuaugggcgucuaccagauucucgcuaucuauuccacaguggccagcucccugguucuucuggugucucucggggccauuagcuuuuggaugugcuccaacggaucucugcaguguagaaucugcaucuga

SEQ ID NO: 185218 - RNA, 1698 nt, Artificial Sequence
  derived and/or modified sequence opt5 from hemagglutinin__InfluenzaA__ABW91526
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaacaggaggggcgcaucaauuauuacuggacgcuucuggagcccggagacacaauuaucuuugaagcgaacggcaaucucauugccccuagauucgcuuuugcccugucccggggguucggaagcggcaucauuaccucuaacgcucccauggaugagugugacgccaagugccagacaccgcaaggcgcgaucaauuccagccuuccuuuucagaacgugcaccccgucaccaucggggaauguccuaaauaugugcgcucuaccagacugcggaugguuacaggacuccgcaauauucccagcauccaguccagaggccuguucggggccauugcuggauuuaucgagggcggguggacgggaaugguggauggcugguacggcuaucaucaccagaacgaacaagggucuggauacgccgcugaccaaaagagcacccagaaugccauuaacggcaucacaaauaaagucaacuccgugaucgagaagaugaauacccaguucacagccguugggaaagaguucaacaagcuggaacggcgcauggagaaucucaacaaaaagguggaugacggauuucuggauauuuggaccuacaacgcugaacuucugguccuccuggagaaugaaagaacgcuugacuuccacgacagcaacgugaagaaucuguaugagaaagucaagucucagcucaaaaacaaugcgaaggagaucggcaacgggugcuuugaguucuaccauaaauguaaugaugaaugcauggaauccgugaagaacggcacauaugacuaccccaaguauagcgaggagucuaaacugaaucgggaaaagauugauggaguuaaacuggaguccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 185219 - RNA, 1698 nt, Artificial Sequence; identical to SEQ ID NO: 184938
  derived and/or modified sequence opt5 from hemagglutinin__InfluenzaA__ABW91537

SEQ ID NO: 185220 - RNA, 1701 nt, Artificial Sequence; identical to SEQ ID NO: 185011
  derived and/or modified sequence opt5 from hemagglutinin__InfluenzaA__ABW91548

SEQ ID NO: 185221 - RNA, 1698 nt, Artificial Sequence
  derived and/or modified sequence opt5 from hemagglutinin__InfluenzaA__ABW91559
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugaaaagaugaauacccaguucacagccguggggaaagaguucaacaaacuggagagacggauggaaaaucucaacaagaagguugacgauggauuucuggacaucuggaccuacaacgcugagcuucuggugcuccuggaaaaugagcgcacgcuugacuuccacgauagcaacgucaaaaaucuguaugaaaaggugaaaucucaacucaagaacaaugcgaaagagauuggcaacgggugcuuugaguucuaccauaaguguaaugacgaaugcauggaguccgucaagaacggcacauaugauuaccccaaauauagcgaagagucuaagcuguacagagagaaaaucgacggagugaagcuggaauccaugggcguuuaucagauucucgccaucuacagcaccguggcuuccucucugguccuucuggugagccucggggccaucuccuuuuggaugugcucuaauggaagccugcagugucggauuugcaucuga

SEQ ID NO: 185222 - RNA, 1698 nt, Artificial Sequence; identical to SEQ ID NO: 185079
  derived and/or modified sequence opt5 from hemagglutinin__InfluenzaA__ABW91570

SEQ ID NO: 185223 - RNA, 1698 nt, Artificial Sequence; identical to SEQ ID NO: 184954
  derived and/or modified sequence opt5 from hemagglutinin__InfluenzaA__ABW91581

SEQ ID NO: 185224 - RNA, 1698 nt, Artificial Sequence; identical to SEQ ID NO: 184934
  derived and/or modified sequence opt5 from hemagglutinin__InfluenzaA__ABW91592

SEQ ID NO: 185225 - RNA, 1698 nt, Artificial Sequence; identical to SEQ ID NO: 184980
  derived and/or modified sequence opt5 from hemagglutinin__InfluenzaA__ABW91603

SEQ ID NO: 185226 - RNA, 1698 nt, Artificial Sequence
  derived and/or modified sequence opt5 from hemagglutinin__InfluenzaA__ABW91614
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgucccccgagaauggcacguguuauccuggguacuuugccgacuaugaggaacugagagagcaacucucuagcgucuccagcuucgaacgguuugagaucuuccccaaggagucuuccuggccuaaccauaccgugacaggaguuagcgccucuugcucccacaauggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuuccagcaaugcucccaugggcgaaugugacgccaagugccagaccccgcaaggggcgaucaacucuagccuuccuuuucagaaugugcaccccgucacaaucggagaguguccuaaauaugugcgcuccgccaagcugagaaugguuaccggccuccggaacauucccucuauccagagccgcgggcuguucggagcuauugccggcuuuaucgaagggggauggaccggcaugguggauggcugguacggguaucaucaccagaaugagcaaggauccggcuacgcugccgaccagaaaagcacacagaacgccauuaaugggaucacgaacaaggucaauucugugaucgaaaagaugaacacccaguucacagcuguuggaaaagaguucaauaaacuggagagacggauggaaaaccucaauaagaagguggaugacggcuuucuggauauuuggaccuacaacgcggagcuucugguccuccuggaaaacgagcgcacacuugacuuccacgacuccaaugugaaaaaccuguaugaaaaggucaaaagccaacucaagaauaacgccaaagagaucgggaauggcugcuuugaguucuaccauaaguguaacgaugaaugcauggagucugugaagaauggaaccuaugacuaccccaaauauuccgaagagagcaagcugaacagagagaaaauugauggcguuaagcuggaauccauggggguguaccagauccucgcuauuuauucuacggucgccagcucccuggugcuucugguuucucucggagccaucagcuuuuggaugugcuccaauggcagccugcagugucggaucugcauuuga

SEQ ID NO: 185227 - RNA, 1698 nt, Artificial Sequence; identical to SEQ ID NO: 184969
  derived and/or modified sequence opt5 from hemagglutinin__InfluenzaA__ABW91625

SEQ ID NO: 185228 - RNA, 1698 nt, Artificial Sequence; identical to SEQ ID NO: 184938
  derived and/or modified sequence opt5 from hemagglutinin__InfluenzaA__ABW91636

SEQ ID NO: 185229 - RNA, 1701 nt, Artificial Sequence; identical to SEQ ID NO: 185011
  derived and/or modified sequence opt5 from hemagglutinin__InfluenzaA__ABW91647

SEQ ID NO: 185230 - RNA, 1707 nt, Artificial Sequence
  derived and/or modified sequence opt5 from hemagglutinin__InfluenzaA__ABX10515
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgugaaugaucugugcuacccuggagacuucaacgauuaugaggaacugaagcaucuccugucucggaucaaucacuuugagaaaauucagaucauucccaagagcuccuggucuagccaugaaguuucccuuggcgugagcucugccuguccuuaccaggggaaauccagcuucuuucgcaacgucguguggcugaucaagaaaaauucuaccuaucccacaauuaagagauccuacaacaauaccaaccaagaggaccuccuggugcuuuggggaauccaccacccuaaugaugccgcugagcagacaaagcuguaucagaacccgaccacguacaucagcgucggcaccucuacacucaaccagcggcugguuccccgcauugccaccagauccaaagugaauggccaaagcgggcggauggaguucuuuuggacaauccugaagccuaacgacgcuauuaauuucgaauccaacggaaauuuuaucgcccccgaauacgcguauaaaauugugaagaaaggcgauucuaccaucaugaaaagcgagcucgaauacgggaacugcaauacgaaaugucagacaccuaugggagccaucaacuccagcaugcccuuccauaauauucacccgcugaccaucggcgagugcccuaaguaugucaagucuaaccgccuugugcuggcuacagggcucagaaauagcccccagcgggagcgcagacggaaaaagcgcggacuguuuggcgccauugcuggcuucaucgaagggggauggcagggcaugguugacgggugguacggauaucaucacuccaacgagcaaggcucuggguacgccgcggacaaagaaagcacccagaaggccauugauggagugaccaauaaagucaacuccaucaucgacaagaugaauacacaguuugaggcugugggcagagaguucaacaaccuugaacggcgcauugagaaucugaacaagaaaauggaagauggcuuccucgacguuuggacguauaaugccgagcugcuggugcucauggaaaacgagagaacccuggauuuucacgacucuaaugucaagaaccuuuacgauaaagugcggcugcaacucaaggacaaugcuaaagaacuggggaacggauguuucgaguuuuaccauaagugcgauaaugaguguauggaaagcgucagaaacggcacauaugacuacccucaguauuccgaggaagcccgccuuaagcgggaggagaucagcggggugaaacuggaaucuauuggaaucuaccagauucucuccaucuauagcaccguugccucuucccuggcucuggcgauuaugguggccggccucagccuguggaugugcuccaaugggucucuucagugcagaaucuguaucuga

SEQ ID NO: 185231 - RNA, 1701 nt, Artificial Sequence; identical to SEQ ID NO: 184880
  derived and/or modified sequence opt5 from hemagglutinin__InfluenzaA__ABX10525

SEQ ID NO: 185232 - RNA, 1698 nt, Artificial Sequence; identical to SEQ ID NO: 184938
  derived and/or modified sequence opt5 from hemagglutinin__InfluenzaA__ABX58239

SEQ ID NO: 185233 - RNA, 1698 nt, Artificial Sequence; identical to SEQ ID NO: 185038
  derived and/or modified sequence opt5 from hemagglutinin__InfluenzaA__ABX58250

SEQ ID NO: 185234 - RNA, 1698 nt, Artificial Sequence
  derived and/or modified sequence opt5 from hemagglutinin__InfluenzaA__ABX58261
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggucccuucuggagcccggagauacgaucauuuuugaggcgaacggcaaucucaucgccccuagauucgcuuuugcccugagccggggguucggaucuggcauuaucacauccaacgcucccauggacgaaugugaugccaagugccagaccccgcaaggcgcgaucaauagcucucuuccuuuucagaacgugcaccccgugacaauuggggaguguccuaaauauguccgcagcaccaagcugagaauggugaccggacuccggaauauccccuccauucagucucgcggccuguucggggccaucgcuggauuuauugaaggcggguggacaggaaugguugacggcugguacggcuaucaucaccagaacgagcaagggagcggauacgccgcugaucagaaauccacgcagaaugccaucaacggcaucaccaauaaggugaacagcgucauugaaaagaugaauacacaguucaccgccguggggaaagaguucaacaaacuggagagacggauggaaaaucucaacaagaagguugacgauggauuucuggacaucuggacauacaacgcugagcuucuggugcuccuggaaaaugagcgcacccuugacuuccacgauucuaacgucaaaaaucuguaugaaaaggugaaaucccaacucaagaacaaugcgaaagagauuggcaacgggugcuuugaguucuaccauaaguguaaugacgaaugcauggagagcgucaagaacggcacguaugauuaccccaaauauucugaagaguccaagcugaauagagagaaaaucgacggagugaagcuggaaagcaugggcguuuaccagauucucgccaucuauuccacaguggcuucuagccugguccuucuggugucccucggggccaucucuuuuuggaugugcagcaacggaucccugcagugucggauuugcaucuga

SEQ ID NO: 185235 - RNA, 1698 nt, Artificial Sequence
  derived and/or modified sequence opt5 from hemagglutinin__InfluenzaA__ABX58272
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaaaagagcucuuggccuaaucauaccgucacaggaguguccgccagcugcucucacaacggcaaguccagcuuuuaccgcaaucugcuuuggcugaccggcaagaacgggcucuaucccaaucugucuaaauccuacgcuaacaauaaggagaaagaaguucuggugcucuggggaguccaucacccuccgaacauuggcgaucagagagcccuguaccacacagagaacgcuuaugugagcguggucuccucucauuacagccggcgcuucacccccgaaaucgccaagagaccuaagguucgggaccaggaggggcgcauuaauuauuacuggacgcuucuggaacccggagauacaaucauuuuugaggcgaacggcaaucucaucgccccuagauucgcuuuugcccugucccggggguucggaagcggcauuaucaccucuaacgcucccauggacgagugugaugccaaaugccagacaccgcaaggcgcgaucaauuccagccuuccuuuucagaacgugcaccccgugaccauuggggaauguccuaaguauguccgcucuaccaaacugagaauggugacaggacuccggaauauccccagcauucagucccgcggccuguucggggccaucgcuggauuuauugagggcggguggacgggaaugguugacggcugguacggcuaucaucaccagaacgaacaagggucuggauacgccgcugaucaaaagagcacccagaaugccaucaacggcaucacaaauaaagugaacuccgucauugagaagaugaauacccaguucacagccguggggaaagaguucaacaagcuggaaagacggauggagaaucucaacaagaaaguugacgauggauuucuggacaucuggaccuacaacgcugaacuucuggugcuccuggagaaugaacgcacgcuugacuuccacgauagcaacgucaagaaucuguaugagaaagugaagucucagcucaaaaacaaugcgaaggaaauuggcaacgggugcuuugaguucuaccauaaguguaaugacgagugcauggaauccgucaaaaacggcacauaugauuaccccaaguauagcgaggaaucuaaacugaauagagagaagaucgacggagugaaacuggaguccaugggcguuuaccagauucucgccaucuauagcaccguggcuuccucucugguccuucuggugagccucggggccaucuccuuuuggaugugcucuaacggaagccugcagugucggauuugcaucuga

SEQ ID NO: 185236 - RNA, 1698 nt, Artificial Sequence; identical to SEQ ID NO: 184938
  derived and/or modified sequence opt5 from hemagglutinin__InfluenzaA__ABX58283

SEQ ID NO: 185237 - RNA, 1698 nt, Artificial Sequence; identical to SEQ ID NO: 185079
  derived and/or modified sequence opt5 from hemagglutinin__InfluenzaA__ABX58294

SEQ ID NO: 185238 - RNA, 1698 nt, Artificial Sequence; identical to SEQ ID NO: 184934
  derived and/or modified sequence opt5 from hemagglutinin__InfluenzaA__ABX58316

SEQ ID NO: 185239 - RNA, 1698 nt, Artificial Sequence; identical to SEQ ID NO: 185083
  derived and/or modified sequence opt5 from hemagglutinin__InfluenzaA__ABX58327

SEQ ID NO: 185240 - RNA, 1698 nt, Artificial Sequence; identical to SEQ ID NO: 184934
  derived and/or modified sequence opt5 from hemagglutinin__InfluenzaA__ABX58338

SEQ ID NO: 185241 - RNA, 1698 nt, Artificial Sequence
  derived and/or modified sequence opt5 from hemagglutinin__InfluenzaA__ABX58360
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgcccauucagcugggcaauuguagcguugcuggguggauccugggaaacccugagugcgaacuccugauuuccaaagagucuuggagcuacaucguggaaaccccgaaucccgagaacggcacguguuauccuggguacuuugccgacuaugaggaacuuagagagcaacuguccucugucagcuccuucgaacgguuugagaucuuccccaaggagagcucuuggccuaaucauaccgugacaggaguuuccgccagcugcucucacaacggcaaguccagcuuuuaccgcaaucuccuguggcuuaccggcaaaaacgggcuguaucccaaucucucuaaguccuacgcuaacaauaaagaaaaggaggugcugguccuguggggagugcaucacccuccgaacauuggcgaucagagagcccucuaccacacagaaaacgcuuaugugagcgucguuuccucucauuacagccggcgcuucacccccgagaucgccaaaagaccuaaggugcgggaccaggaagggcgcauuaauuauuacuggacgcugcuugagcccggagauacaaucauuuuugaggcgaacggcaaucugaucgccccuagauucgcuuuugcccucucccggggguucggaagcggcauuaucaccucuaacgcucccauggacgaaugugaugccaagugccagacaccgcaaggcgcgaucaauuccagccugccuuuucagaacgugcaccccgucaccauuggggaguguccuaaauaugugcgcucuaccaaacuuagaaugguuacaggacugcggaauauccccagcauucagucccgcggccucuucggggccaucgcuggauuuauugaaggcggguggacgggaaugguggacggcugguacggcuaucaucaccagaacgagcaagggucuggauacgccgcugaucagaaaagcacccagaaugccaucaacggcaucacaaauaaggucaacuccgugauugaaaagaugaauacccaguucacagccguugggaaggaguucaacaaacuggagagacggauggaaaaucugaacaagaagguggacgauggauuucucgacaucuggaccuacaacgcugagcugcuuguccugcucgaaaaugagcgcacgcuggacuuccacgauagcaacgugaaaaaucuuuaugaaaaggucaaaucucaacugaagaacaaugcgaaagagauuggcaacgggugcuuugaguucuaccauaaguguaaugacggcugcauggaauccgugaagaacggaacauaugauuaccccaaauauagcgaggaaucuaagcucaauagagagaaaaucgacggcguuaagcuggaguccauggggguguaccagauucuggccaucuauagcaccgucgcuuccucucucgugcugcuuguuagccugggagccaucuccuuuuggaugugcucuaacggcagccuccagugucggauuugcaucuga

SEQ ID NO: 185242 - RNA, 1698 nt, Artificial Sequence; identical to SEQ ID NO: 184938
  derived and/or modified sequence opt5 from hemagglutinin__InfluenzaA__ABX58371

SEQ ID NO: 185243 - RNA, 1698 nt, Artificial Sequence; identical to SEQ ID NO: 184938
  derived and/or modified sequence opt5 from hemagglutinin__InfluenzaA__ABX58382

SEQ ID NO: 185244 - RNA, 1698 nt, Artificial Sequence; identical to SEQ ID NO: 185079
  derived and/or modified sequence opt5 from hemagglutinin__InfluenzaA__ABX58393

SEQ ID NO: 185245 - RNA, 1698 nt, Artificial Sequence; identical to SEQ ID NO: 184938
  derived and/or modified sequence opt5 from hemagglutinin__InfluenzaA__ABX58404

SEQ ID NO: 185246 - RNA, 1698 nt, Artificial Sequence
  derived and/or modified sequence opt5 from hemagglutinin__InfluenzaA__ABX58415
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaaaaguccuggucuuacauuguggagaccccgaaucccgaaaacggcacguguuauccuggguacuuugccgacuaugaggagcugcgggaacaacucagcuccgucucuagcuucgagcgcuuugaaaucuuccccaaggaguccagcuggccuaaucauaccgugacaggaguuucugccuccugcagccacaacggcaaaucuuccuuuuacagaaaucugcuuuggcugaccggcaagaacgggcucuaucccaaucugagccggucuuacgcuaacaauaaagagaaggaagugcugguccucuggggagugcaucacccuccgaacaucggcgaucagcgcgcccuguaccacacagagaacgcuuauguguccgucguuagcucccauuacucuagacgguucacccccgaaauugccaaacgcccuaaggugagagaccaggaggggcggaucaauuauuacuggacgcuucuggaacccggagauacaauuaucuuugaggcgaacggcaaucucauugccccucgcuucgcuuuugcccugagcagaggguucggauccggcaucauuaccagcaacgcucccauggacgagugugaugccaagugccagacaccgcaaggcgcgaucaauucuucccuuccuuuucagaacgugcaccccgucaccaucggggaauguccuaaauaugugcggagcgccaagcugcgcaugguuaccggacucagaaauauucccucuauccagagccggggccuguucggggcuauugccggauuuaucgagggcggguggacaggaaugguggacggcugguacggcuaucaucaccagaacgaacaaggguccggauacgcugccgaucagaaaucuacgcagaaugccauuaacggcaucaccaauaaggucaacagcgugaucgagaaaaugaauacacaguucaccgcuguugggaaggaguucaacaaacuggaacgcagaauggagaaucucaacaagaagguggacgauggauuucuggacauuuggacauacaacgcggaacuucugguccuccuggagaaugaacggacccuugacuuccacgauuccaacgugaaaaaucuguaugagaaggucaaaagccaacucaagaacaaugccaaagaaaucggcaacgggugcuuugaguucuaccauaaguguaaugacgagugcauggaaucugugaagaacggcacguaugauuaccccaaauauuccgaggaaagcaagcugaauagagagaaaauugacggaguuaagcuggagucuaugggcguguaccagauccucgcuauuuauuccacagucgccagcucccuggugcuucugguuucucucggggccaucagcuuuuggaugugcuccaacggaucucugcagugucgcaucugcauuuga

SEQ ID NO: 185247 - RNA, 1698 nt, Artificial Sequence; identical to SEQ ID NO: 184938
  derived and/or modified sequence opt5 from hemagglutinin__InfluenzaA__ABX58426

SEQ ID NO: 185248 - RNA, 1698 nt, Artificial Sequence; identical to SEQ ID NO: 184938
  derived and/or modified sequence opt5 from hemagglutinin__InfluenzaA__ABX58437

SEQ ID NO: 185249 - RNA, 1698 nt, Artificial Sequence; identical to SEQ ID NO: 184934
  derived and/or modified sequence opt5 from hemagglutinin__InfluenzaA__ABX58448

SEQ ID NO: 185250 - RNA, 1698 nt, Artificial Sequence; identical to SEQ ID NO: 184980
  derived and/or modified sequence opt5 from hemagglutinin__InfluenzaA__ABX58459

SEQ ID NO: 185251 - RNA, 1698 nt, Artificial Sequence; identical to SEQ ID NO: 185079
  derived and/or modified sequence opt5 from hemagglutinin__InfluenzaA__ABX58470

SEQ ID NO: 185252 - RNA, 1698 nt, Artificial Sequence; identical to SEQ ID NO: 184980
  derived and/or modified sequence opt5 from hemagglutinin__InfluenzaA__ABX58481

SEQ ID NO: 185253 - RNA, 1698 nt, Artificial Sequence; identical to SEQ ID NO: 184938
  derived and/or modified sequence opt5 from hemagglutinin__InfluenzaA__ABX58492

SEQ ID NO: 185254 - RNA, 1698 nt, Artificial Sequence; identical to SEQ ID NO: 184954
  derived and/or modified sequence opt5 from hemagglutinin__InfluenzaA__ABX58503

SEQ ID NO: 185255 - RNA, 1698 nt, Artificial Sequence; identical to SEQ ID NO: 184980
  derived and/or modified sequence opt5 from hemagglutinin__InfluenzaA__ABX58525

SEQ ID NO: 185256 - RNA, 1698 nt, Artificial Sequence
  derived and/or modified sequence opt5 from hemagglutinin__InfluenzaA__ABX58536
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagagccgugguccuacauuguggaaacccccaauccugagaacggcacguguuaucccggguacuuugccgacuaugaggaacugcgggagcaacucucuagcgucuccucuuucgaacgcuuugagaucuucccuaaggagagcuccuggcccaaucauaccgugacaggaguuagcgccucuugcucccacaacggcaagagcucuuuuuacagaaaucugcuuuggcugaccggcaaaaacgggcucuauccuaaucugucccggagcuacgcuaacaauaaggaaaaagaggugcugguccucuggggagugcaucacccgcccaacaucggcgaucagcgcgcccuguaccacacagaaaacgcuuaugugucugucguuuccagccauuacuccagacgguucaccccugagauugccaagcgccccaaagugagagaccaggaagggcggaucaauuauuacuggacgcuucuggagccuggagauacaauuaucuuugaggcgaacggcaaucucauugcuccccgcuucgccuuugcccugucuagaggguucggaagcggcaucauuaccuccaacgcuccgauggacgaaugugaugccaagugccagacaccucaaggcgcgaucaauagcucucuucccuuucagaacgugcacccugucaccaucggggagugucccaaguaugugcgguccgccaaacugcgcaugguuaccggacucagaaauauucccagcauccagucucggggccuguucggggcuauugccggauuuaucgaaggcggguggacaggaaugguggacggcugguacggcuaucaucaccagaacgagcaagggagcggauacgcugccgaucagaaguccacgcagaaugccauuaacggcaucaccaauaaagucaacucugugaucgaaaagaugaauacacaguucaccgcuguugggaaagaguucaacaagcuggagcgcagaauggaaaaucucaacaaaaagguggacgauggauuucuggacauuuggacauacaacgcggagcuucugguccuccuggaaaaugagcggacccuugacuuccacgauagcaacgugaagaaucuguaugaaaaagucaagucccaacucaaaaacaaugccaaggagaucggcaacgggugcuuugaguucuaccauaaauguaaugacgaaugcauggagagcgugaagaacggcacguaugauuacccuaaguauucugaagaguccaaacugaauagagagaagauugacggaguuaaacuggaaagcaugggcguguaccagauccucgcuauuuauucuacagucgccuccagccuggugcuucugguuucccucggggccaucucuuuuuggaugugcagcaacggaucccugcagugucgcaucugcauuuga

SEQ ID NO: 185257 - RNA, 1698 nt, Artificial Sequence
  derived and/or modified sequence opt5 from hemagglutinin__InfluenzaA__ABX58547
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagacgcgcggccuguucggggccaucgcuggauuuauugaaggcggguggaccggaaugguugacggcugguacggcuaucaucaccagaacgagcaaggguccggauacgccgcugaucagaaaucuacacagaaugccaucaacggcaucaccaauaaggugaacagcgucauugaaaagaugaauacacaguucaccgccguggggaaagaguucaacaaacuggagagacggauggaaaaucucaacaagaagguugacgauggauuucuggacaucuggacguacaacgcugagcuucuggugcuccuggaaaaugagcgcacacuugacuuccacgauuccaacgucaaaaaucuguaugaaaaggugaaaagccaacucaagaacaaugcgaaagagauuggcaacgggugcuuugaguucuaccauaaguguaaugacgaaugcauggagucugucaagaacggcaccuaugauuaccccaaauauuccgaagagagcaagcugaauagagagaaaaucgacggagugaagcuggaaucuaugggcguuuaccagauucucgccaucuauuccaccguggcuagcucccugguccuucuggugucucucggggccaucagcuuuuggaugugcuccaacggaucucugcagugucggauuugcaucuga

SEQ ID NO: 185258 - RNA, 1698 nt, Artificial Sequence
  derived and/or modified sequence opt5 from hemagglutinin__InfluenzaA__ABX58558
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggccgcuccagcuuuuacagaaaucugcuuuggcugaccggcaagaacgggcucuaucccaaucugucuaaauccuacgcuaacaauaaggaaaaagaggugcugguccucuggggagugcaucacccuccgaacaucggcgaucagcgggcccuguaccacacagaaaacgcuuaugugagcgucguuuccucucauuacagccgcagauucacccccgagauugccaagcggccuaaagugcgcgaccaggaagggagaaucaauuauuacuggacgcuucuggagcccggagauacaauuaucuuugaggcgaacggcaaucucauugccccucgguucgcuuuugcccugucccgcggguucggaagcggcaucauuaccucuaacgcucccauggacaagugugaugccaagugccagacaccgcaaggcgcgaucaauuccagccuuccuuuucagaacgugcaccccgucaccaucggggaauguccuaaauaugugagaucuaccaagcugcggaugguuacaggacuccgcaauauucccagcauccaguccagaggccuguucggggccauugcuggauuuaucgagggcggguggacgggaaugguggacggcugguacggcuaucaucaccagaacgaacaagggucuggauacgccgcugaucagaaaagcacccagaaugccauuaacggcaucacaaauaaggucaacuccgugaucgagaaaaugaauacccaguucacagccguugggaaggaguucaacaaacuggaacggcgcauggagaaucucaacaagaagguggacgauggauuucuggacauuuggaccuacaacgcugaacuucugguccuccuggagaaugaaagaacgcuugacuuccacgauagcaacgugaaaaaucuguaugagaaggucaaaucucaacucaagaacaaugcgaaagaaaucggcaacgggugcuuugaguucuaccauaaguguaaugacgagugcauggaauccgugaagaacggcacauaugauuaccccaaauauagcgaggaaucuaagcugaaucgggagaaaauugacggaguuaagcuggaguccaugggcguguaccagauccucgccauuuauagcaccgucgcuuccucucuggugcuucugguuagccucggggccaucuccuuuuggaugugcucuaacggaagccugcaguguagaaucugcauuuga

SEQ ID NO: 185259 - RNA, 1698 nt, Artificial Sequence
  derived and/or modified sequence opt5 from hemagglutinin__InfluenzaA__ABX58569
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgccacaggagucuccgcuagcugcucucacaacggcaaguccagcuuuuaccgcaaucugcuuuggcugaccggcaaaaacgggcucuaucccaaucugucuaaguccuacgccaacaauaaagaaaaggaggugcugguucucuggggagugcaucacccuccgaacauuggcgaucagagagcucuguaccacacagaaaacgccuaugucagcgugguguccucucauuacagccggcgcuucacccccgagaucgcgaaaagaccuaagguccgggaccaggaagggcgcauuaauuauuacuggacgcuucuggagcccggagauacaaucauuuuugaggccaacggcaaucucaucgcuccuagauucgccuuugcucugucccggggguucggaagcggcauuaucaccucuaacgcccccauggacgaaugugaugcgaagugccagacaccgcaaggcgccaucaauuccagccuuccuuuucagaacguucaccccgugaccauuggggaguguccuaaauaugugcgcucuaccaagcugagaauggucacaggacuccggaauauccccagcauucagucccgcggccuguucggggcuaucgccggauuuauugaaggcggguggacgggaaugguggacggcugguacggcuaucaucaccagaacgagcaagggucuggauacgcugccgaucagaaaagcacccagaaugccaucaacggcaucacaaauaagguuaacuccgugauugaaaagaugaauacccaguucacagcugucgggaaagaguucaacaaacuggagagacggauggaaaaucucaacaagaagguggacgauggauuucuggacaucuggaccuacaacgcggagcuucugguucuccuggaaaaugagcgcacgcuugacuuccacgauagcaacgugaaaaaucuguaugaaaaggucaaaucucaacucaagaacaaugccaaagagauuggcaacgggugcuuugaguucuaccauaaguguaaugacgaaugcauggaguccgugaagaacggcacauaugauuaccccaaauauagcgaagagucuaagcugaauagagagaaaaucgacggagucaagcuggaauccaugggcguguaccagauucucgcuaucuauagcaccguugccuccucucuggugcuucuggucagccucggggccaucuccuuuuggaugugcucuaacggaagccugcagugucggauuugcaucuga

SEQ ID NO: 185260 - RNA, 1698 nt, Artificial Sequence; identical to SEQ ID NO: 184934
  derived and/or modified sequence opt5 from hemagglutinin__InfluenzaA__ABX58580

SEQ ID NO: 185261 - RNA, 1698 nt, Artificial Sequence; identical to SEQ ID NO: 184938
  derived and/or modified sequence opt5 from hemagglutinin__InfluenzaA__ABX58591

SEQ ID NO: 185262 - RNA, 1698 nt, Artificial Sequence
  derived and/or modified sequence opt5 from hemagglutinin__InfluenzaA__ABX58602
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucgagggaaucgcgccccugcagcugggcaauuguagcguugcuggguggauucucggaaacccugaaugcgagcugcuuaucuccaaggaaucuuggagcuacauuguggagaccccgaaucccgagaacggcacguguuauccuggguacuuugccgacuaugaagaacugagagaacaacucuccucugucagcuccuucgagcgguuugagaucuuccccaaagaaagcucuuggccuaaucauaccgugacaggaguuuccgccagcugcucucacaacggcaaguccagcuuuuaccgcaaucugcuuuggcugaccggcaagaacgggcucuaucccaaucugucuaaauccuacgcuaacaauaaggagaaagaagugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccagagauacaauuaucuuugaagcgaacggaaaucucauugccccucgguucgcuuuugcccugucccgcggcuucgggagcggaaucauuaccucuaacgcucccaugggcgagugugacgccaagugccagacaccgcaaggcgcgaucaauuccagccuuccuuuucagaacgugcaccccgucaccaucggggaauguccuaaguaugugagaucugccaaacugcggaugguuaccggacuccgcaauauucccagcauccaguccagaggccuguucggggcuauugccggauuuaucgagggcggguggacaggaaugguggauggcugguacggcuaucaucaccagaacgaacaagggucuggauacgcugccgaccaaaagagcacgcagaaugccauuaacggcaucaccaauaaagucaacuccgugaucgagaagaugaauacacaguucaccgcuguugggaaagaguucaacaagcuggaacggcgcauggagaaucucaacaaaaagguggaugacggauuucuggauauuuggacauacaacgcggaacuucugguccuccuggagaaugaaagaacccuugacuuccacgacagcaacgugaagaaucuguaugagaaagucaagucucagcucaaaaacaaugccaaggagaucggcaacgggugcuuugaguucuaccauaaauguaaugaugagugcauggaauccgugaagaacggcacguaugacuaccccaaguauagcgaggagucuaaacugaaucgggaaaagauugauggaguuaaacuggaguccaugggcguguaccagauccucgcuauuuauagcacagucgccuccucucuggugcuucugguuagccucggggccaucuccuuuuggaugugcucuaacggaagccugcaguguagaaucugcauuuga

SEQ ID NO: 185263 - RNA, 1698 nt, Artificial Sequence; identical to SEQ ID NO: 184971
  derived and/or modified sequence opt5 from hemagglutinin__InfluenzaA__ABX58613

SEQ ID NO: 185264 - RNA, 1698 nt, Artificial Sequence; identical to SEQ ID NO: 184938
  derived and/or modified sequence opt5 from hemagglutinin__InfluenzaA__ABX58624

SEQ ID NO: 185265 - RNA, 1698 nt, Artificial Sequence
  derived and/or modified sequence opt5 from hemagglutinin__InfluenzaA__ABX58635
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggccgcuccagcuuuuacagaaaucugcuuuggcugaccggcaagaacgggcucuaucccucucuguccaaaagcuacgcuaauaacaaggaaaaagaggugcugguccucuggggagugcaucacccuccgaauaucggcgaucagcgggcccuguaccacacagaaaacgcuuauguguccgucguuucuagccauuacucccgcagauucacccccgagauugccaagcggccuaaagugcgcgaccaggaagggagaaucaacuauuacuggacgcuucuggagcccggagauacaauuaucuuugaggcgaauggcaaccucauugccccucgguucgcuuuugcccugagccgcggguucggaucuggcaucauuaccuccaaugcucccauggacgaaugugaugccaagugccagacaccgcaaggcgcgaucaacagcucucuuccuuuucagaaugugcaccccgucaccaucggggaguguccuaaguaugugagaagcaccaaacugcggaugguuacaggacuccgcaacauucccuccauccagucuagaggccuguucggggccauugcuggauuuaucgaaggcggguggacgggaaugguggacggcugguacggcuaucaucaccagaaugagcaagggagcggauacgccgcugaucagaaguccacccagaacgccauuaauggcaucacaaacaaagucaauagcgugaucgaaaagaugaacacccaguucacagccguugggaaagaguucaauaagcuggagcggcgcauggaaaaccucaauaaaaagguggacgauggauuucuggacauuuggaccuacaacgcugagcuucugguccuccuggaaaacgagagaacgcuugacuuccacgauucuaaugugaagaaccuguaugaaaaagucaagucccaacucaaaaauaacgcgaaggagaucggcaaugggugcuuugaguucuaccauaaauguaacgacgaaugcauggagagcgugaagaauggcacauaugauuaccccaaguauucugaagaguccaaacugaaccgggagaagauugacggaguuaaacuggaaagcaugggcguguaccagauccucgccauuuauuccaccgucgcuucuagccuggugcuucugguuucccucggggccaucucuuuuuggaugugcagcaauggaucccugcaguguagaaucugcauuuga

SEQ ID NO: 185266 - RNA, 1698 nt, Artificial Sequence; identical to SEQ ID NO: 184934
  derived and/or modified sequence opt5 from hemagglutinin__InfluenzaA__ABX58679

SEQ ID NO: 185267 - RNA, 1698 nt, Artificial Sequence; identical to SEQ ID NO: 184980
  derived and/or modified sequence opt5 from hemagglutinin__InfluenzaA__ABX58701

SEQ ID NO: 185268 - RNA, 1698 nt, Artificial Sequence; identical to SEQ ID NO: 185038
  derived and/or modified sequence opt5 from hemagglutinin__InfluenzaA__ABX58712

SEQ ID NO: 185269 - RNA, 1704 nt, Artificial Sequence
  derived and/or modified sequence opt5 from hemagglutinin__InfluenzaA__ABY19417
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggaaaagacacacaaugggaagcucugugaucuggacggagucaaaccccuuauccugagagauugcagcguggcgggcuggcuccuggggaacccuaugugugacgaguucauuaauguuccggaaugguccuauaucguggagaaggcuaaccccgccaaugaucugugcuacccuggaaacuuuaaugacuaugaggaacucaagcaucugcuuucucggauuaaccacuucgagaaaauccagauuauccccaagagcuccuggucugaucaugaagccagcuccggcgucagcucugcuuguccuuaccagggggugcccuccuuuuuccgcaauguuguguggcugauuaaaaagaacaauaccuauccuacaaucaaaagaagcuacaacaauaccaaccaagaggaccuccugauccuuugggggauucaccacucuaacgaugccgcugagcagacaaagcuguaucagaauccgaccacguacaucuccgucggcaccagcacacucaaccagcggcuggugcccaagauugccacccgcucuaaagugaauggccaauccgggagaauggacuuuuucuggacaauccugaagccuaacgaugcgauuaauuuugaaagcaacggaaauuucaucgcccccgaguacgcuuauaaaaucgucaagaaaggcgacuccgccauuaugaagucugaaguugaguacgggaacugcaauaccaaaugucagacgccuaucggagcuauuaacagcuccaugcccuuucauaauauccacccgcucacaauuggcgaaugcccuaaguaugugaaaagcaacaaacuggugcuugccaccgggcugcgcaauucuccccuccgggagagacggcgcaagagaggacuguucggcgcgaucgccggcuuuaucgagggaggauggcagggcauggucgacgggugguacggauaucaucacuccaacgaacagggcagcggguacgcugccgauaaagagucuacacaaaaggcuauugacggagugaccaauaaaguuaacagcaucauugauaagaugaacacccaguucgaagccgugggccgggaguuuaauaaccuugaacgcagaaucgagaaucugaacaagaaaauggaggacggcuuccucgaugucuggacauauaaugccgaacugcuggugcucauggagaacgaacggacgcuggacuuccacgauuccaauguuaagaaccuuuacgacaaagugcgccugcagcucagagauaaugcuaaggagcuggggaacggauguuuuaaauucuaccauaagugcgacaaugaauguauggagucuguccggaacggcaccuaugauuacccucaauauagcgaggaagcgagacuuaagcgcgaggaaauuuccggggugaaacuggagagcaucggaacauaccagauucucucuaucuauuccaccgucgccagcucucuggcucuggccaucaugguggccggccucucccuguggaugugcagcaaugggucccuucagugccggauuagaaucuga

SEQ ID NO: 185270 - RNA, 1704 nt, Artificial Sequence
  derived and/or modified sequence opt5 from hemagglutinin__InfluenzaA__ABY19418
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggaaaagacacacaaugggaagcucugugaucuggacggagucaaaccccuuauccugagagauugcagcguggcgggcuggcuccuggggaacccuaugugugacgaguucauuaauguuccggaaugguccuauaucguggagaaggcuaaccccgccaaugaucugugcuacccuggagacuuuaacgauuaugaggaacucaagcaucugcuuucucggauuaaucacuucgagaaaauccagauuauccccaagagcuccuggucugaccaugaagccagcuccggcgucagcucugcuuguccuuaccagggggugcccuccuuuuuccgcaacguuguguggcugauuaaaaagaauaacaccuauccuacaaucaaaagaagcuacaauaacaccaaucaagaggaucuccugauccuuugggggauucaccacucuaacgacgccgcugagcagacaaagcuguaucagaacccgaccacguacaucuccgucggcaccagcacacucaaucagcggcuggugcccaagauugccacccgcucuaaagugaacggccaauccgggagaauggacuuuuucuggacaauccugaagccuaaugaugcgauuaacuuugaaagcaauggaaacuucaucgcccccgaguacgcuuauaaaaucgucaagaaaggcgacuccgccauuaugaagucugaaguugaguacgggaauugcaacaccaaaugucagacgccuaucggagcuauuaauagcuccaugcccuuucauaacauccacccgcucacaauuggcgaaugcccuaaguaugugaaaagcaauaaacuggugcuugccaccgggcugcggaacucuccccuccgcgagagacggcgcaagagaggacuguucggcgcgaucgccggcuuuaucgagggaggauggcagggcauggucgaugggugguacggauuccaucacuccaaugaacagggcagcggguaugcugccgacaaagagucuacacaaaaggcuauugauggagugaccaacaaaguuaauagcaucauugacaagaugaacacccaguuugaagccgugggccgggaguucaacaaucuugaacgcagaaucgagaaccugaauaagaaaauggaggauggcuuccucgacgucuggacauacaacgccgaacugcuggugcucauggagaaugaacggacgcuggauuuucacgacuccaacguuaagaaucuuuaugauaaagugcgccugcagcucagagacaacgcuaaggagcuggggaauggauguuucgaauuuuaccauaaaugcgauaacgaguguauggagucuguccggaauggcaccuacgacuauccucaauacagcgaagaggcgagacuuaagcgcgaagagauuuccggggugaagcuggagagcaucggaacauaucagauucucucuaucuacuccaccgucgccagcucucuggcucuggccaucaugguggccggccucucccuguggaugugcagcaacgggucccuucagugccggauuuguaucuga

SEQ ID NO: 185271 - RNA, 1704 nt, Artificial Sequence
  derived and/or modified sequence opt5 from hemagglutinin__InfluenzaA__ABY19419
auggagaagaucgugcugcuccuggccauuaucagccuugucaaauccgaccagauuugcaucggcuaccacgcuaacaauucuaccgaacaaguugauacaauuauggagaagaacgugacggugacccaugcccaggacauccuggaaaagacacacaaugggaagcucugugaucuggacggagucaaaccccuuauccugagagauugcagcguggcgggcuggcuccuggggaacccuaugugugacgaguucauuaauguuccggaaugguccuauaucguggagaaggcuaaccccgccaaugaucugugcuacccuggaaacuuuaaugacuaugaggaacucaagcaucugcuuucucggauuaaccacuucgagaaaauccagauuauccccaagagcuccuggucugaucaugaagccagcuccggcgucagcucugcuuguccuuaccagggggugcccuccuuuuuccgcaauguuguguggcugauuaaaaagaacaauaccuauccuacaaucaaaagaagcuacaacaauaccaaccaagaggaccuccugauccuuuggggcauucaccacucuaacgaugccgcugagcagacaaagcuguaucagaauccgaccacguacaucuccgucggaaccagcacacucaaccagcggcuggugcccaagauugccacccgcucuaaagugaauggccaauccgggagaauggacuuuuucuggacaauccugaagccuaacgaugcgauuaauuuugaaagcaacggaaauuucaucgcccccgaguacgcuuauaaaaucgucaagaaaggcgacuccgccauuaugaagucugaaguugaguacgggaacugcaauaccaaaugucagacgccuaucggagcuauuaacagcuccaugcccuuucauaauauccacccgcucacaauuggcgaaugcccuaaguaugugaaaagcaacaaacuggugcuugccaccgggcugcgcaauucuccccuccgggagagacggcgcaagagaggacuguucggcgcgaucgccggcuuuaucgaagggggauggcagggcauggucgacgggugguacggauaucaucacuccaacgaacagggcagcggguacgcugccgauaaagagucuacacaaaaggcuauugacggagugaccaauaaaguuaacagcaucauugauaagaugaacacccaguucgaagccgugggccgggaguuuaauaaccuugaacgcagaaucgagaaucugaacaagaaaauggaggacggcuuccucgaugucuggacauauaaugccgaacugcuggugcucauggagaacgaacggacgcuggacuuccacgauuccaauguuaagaaccuuuacgacaaagugcgccugcagcucagagauaaugcuaaggagcuggggaacggauguuuugaguucuaccauaaaugcgacaaugaguguauggagucuguccggaacggcaccuaugauuacccucaauauagcgaagaggcgagacuuaagcgcgaagagauuuccggggugaagcuggagagcaucggaacauaccagauucucucuaucuauuccaccgucgccagcucucuggcucuggccaucaugguggccggccucucccuguggaugugcagcaaugggucccuucagugccggauuuguaucuga

SEQ ID NO: 185272 - RNA, 1698 nt, Artificial Sequence; identical to SEQ ID NO: 185079
  derived and/or modified sequence opt5 from hemagglutinin__InfluenzaA__ABY51017

SEQ ID NO: 185273 - RNA, 1701 nt, Artificial Sequence; identical to SEQ ID NO: 184952
  derived and/or modified sequence opt5 from hemagglutinin__InfluenzaA__ABY51028

SEQ ID NO: 185274 - RNA, 1698 nt, Artificial Sequence
  derived and/or modified sequence opt5 from hemagglutinin__InfluenzaA__ABY51039
augaaggugaaacugcucguccugcuuugcaccuucacagccacgaacgcugacaccaucuguauuggcuaccacgccaauaacagcacagauaccguugacacagugcuggagaagaaugugaccgucacacauuccgugaaccuccuggaaaauucucacaacgggaaacuuugccugcucaagggaaucgcgccccugcagcugggcaauuguagcguugcuggguggauucucggaaacccugagugcgaacugcuuaucuccaaagagucuuggagcuauauuguggaaaccccgaaucccgagaacggcacguguuacccugggcauuuugccgauuaugaggaacugagagagcaacucuccucugucagcuccuucgaacgguuugagaucuuccccaaggagagcucuuggccuaaucacaccgugacaggaguuuccgccagcugcucucauaacggcgaauccagcuuuuaccgcaaucugcuuuggcugaccggcaagaacgggcucuaucccaaucugucuaaauccuacgcuaacaacaaggagaaagaagugcugguccucuggggagugcaccacccuccgaauaucggcgaccagaaggcccuguaucauacagagaacgcuuacgugagcgucguuuccucucacuacagcagaaaauucacccccgaaauugccaagcggccuaaggugcgcgaucaggaggggagaaucaauuauuacuggacgcuucuggagcccggagacacaauuaucuuugaagcgaacggcaaucucauugccccucgguaugcuuucgcccugucccgcggguuuggaagcggcaucauuaacucuaaugcucccauggauaaaugugacgccaagugccagaccccgcaaggcgcgaucaacuccagccuuccuuuccagaaugugcaucccgucacaaucggggaguguccuaaauacgugagaucugccaagcugcggaugguuaccggacuccgcaacauucccagcauccaguccagaggccuguuuggggcuauugccggauucaucgaaggcggguggaccggaaugguggauggcugguauggcuaccaccaccagaaugagcaagggucuggauaugcugccgaccagaaaagcacacagaacgccauuaauggcaucacgaacaaggucaauuccgugaucgaaaagaugaacacccaguuuacagcuguugggaaagaguucaacaagcuggagcggcgcauggaaaaucucaacaaaaagguggaugacggauucauugauaucuggaccuacaaugcggagcugcuuguccugcucgaaaacgagagaacacuggacuuucaugacagcaaugugaaaaaccuuuacgaaaaggucaaaggccaacugaagaauaacgccaaggagauugggaauggcugcuucgaguuuuaucacaaauguaacgaugaaugcauggagucugugaagaauggaaccuacgacuaucccaaauacuccgaagagagcaagcucaaccgggagaaaaucgauggcguuaagcuggaaucuauggggguguaucagauucuggcuaucuacuccacggucgccagcucccucgugcugcuuguuucucugggagccaucagcuucuggaugugcuccaauggcucucuccagugucgcauuugcaucuga

SEQ ID NO: 185275 - RNA, 1698 nt, Artificial Sequence
  derived and/or modified sequence opt5 from hemagglutinin__InfluenzaA__ABY51050
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacuccaaaugccagacaccgcaaggcgccaucaauagcucucuuccuuuccagaacgugcaucccgucaccaucggggaguguccuaaguaugugagaagcgcgaaacugcggaugguuacaggacuccgcaauauucccuccauccagucuagaggccuguuuggggccauugcuggauucaucgaaggcggguggaccggaaugguggauggcugguacggcuaucaccaccagaacgagcaagggagcggauacgccgcugaccagaaguccacccagaaugccauuaacggcaucacaaauaaagucaacagcgugaucgaaaagaugaauacgcaguuuaccgccguugggaaggaguucaacaaacuggagcggcgcauggaaaaccucaauaagaaaguggaugacggauucauugauaucuggacauacaacgcugagcugcuuguccugcucgaaaaugagagaacccuggacuuucaugacucuaacgugaagaaucuuuaugaaaaagucaagucccaacugaagaacaaugcgaaagagauuggcaacgggugcuucgaguuuuaccacaaguguaaugaugaaugcauggagagcgugaaaaacggcacauaugacuaccccaaguauucugaagaguccaaacucaaucgggagaagaucgauggaguuaagcuggaaagcaugggcguguaccagauucuggccaucuauuccaccgucgcuucuagccucgugcugcuuguuucccugggggccaucucuuucuggaugugcagcaacggaucccuccagugucgcauuugcaucuga

SEQ ID NO: 185276 - RNA, 1698 nt, Artificial Sequence; identical to SEQ ID NO: 185038
  derived and/or modified sequence opt5 from hemagglutinin__InfluenzaA__ABY51061

SEQ ID NO: 185277 - RNA, 1698 nt, Artificial Sequence
  derived and/or modified sequence opt5 from hemagglutinin__InfluenzaA__ABY51072
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucuaccaagcugagaauggugacaggacuccggaauauccccagcauucagucccgcggccuguucggggccaucgcuggauuuauugaaggcggguggacgggaaugguugacggcugguacggcuaucaucaccagaacgagcaagggucuggauacgccgcugaucagaaaagcacccagaaugccaucaacggcaucacaaauaaggugaacuccgucauugagaaaaugaauacccaguucacagccguggggaaggcuuucaacaaacuggaaagacggauggagaaucucaacaagaagguugacgauggauuucuggacaucuggaccuacaacgcggaacuucuggugcuccuggagaaugaacgcacgcuugacuuccacgauagcaacgucaaaaaucuguaugagaaggugaaaucucaacucaagaacaaugccaaagaaauuggcaacgggugcuuugaguucuaccauaaguguaaugacgagugcauggaauccgucaagaacggcacauaugauuaccccaaauauagcgaggaaucuaagcugaauagagagaaaaucgacggagugaagcuggaguccaugggcguuuaccagauucucgcuaucuauagcaccguggccuccucucugguccuucuggugagccucggggccaucuccuuuuggaugugcucuaacggaagccugcagugucggauuugcaucuga

SEQ ID NO: 185278 - RNA, 1698 nt, Artificial Sequence; identical to SEQ ID NO: 184980
  derived and/or modified sequence opt5 from hemagglutinin__InfluenzaA__ABY51083

SEQ ID NO: 185279 - RNA, 1698 nt, Artificial Sequence; identical to SEQ ID NO: 184938
  derived and/or modified sequence opt5 from hemagglutinin__InfluenzaA__ABY51094

SEQ ID NO: 185280 - RNA, 1698 nt, Artificial Sequence; identical to SEQ ID NO: 185079
  derived and/or modified sequence opt5 from hemagglutinin__InfluenzaA__ABY51105

SEQ ID NO: 185281 - RNA, 1698 nt, Artificial Sequence; identical to SEQ ID NO: 184938
  derived and/or modified sequence opt5 from hemagglutinin__InfluenzaA__ABY51116

SEQ ID NO: 185282 - RNA, 1701 nt, Artificial Sequence
  derived and/or modified sequence opt5 from hemagglutinin__InfluenzaA__ABY51127
augaagaccaucauugcccugagcuacauccucugcaugguguucgcucagaaacugcccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuucaaaacaaaaagugggaucuguucgucgagagaagcaaagccuauuccaauuguuacccuuaugacgugcccgauuacgcuucucugcggagccucguugccuccagcgggacgcuggaauuuaacaaugagucuuucaacuggaccggagugacacagaauggcaccuccagcgcuugcauccgcagaucuaacaauuccuuuuucagccggcuuaacuggcugacacaucucaaguuuaaguauccugcccugaaugucaccaugcccaacaacgagaaauucgacaaacuuuacauuuggggcgugcaccauccugggacggauaaugaccagguuuuucuguaugcgcaggccucuggacgcaucacaguguccaccaagagaagccaacagacagucauuccgaacaucggcucccggccccgcgugagaaauauuccuucucggaucagcaucuacuggaccauugugaagcccggggauauccuccugauuaacuccaccggaaaucugaucgcuccucgcggcuacuucaaaauuagaagcgggaagucuuccaucaugcggagcgacgcccccaucggaaaguguaacucugaaugcauuacaccgaauggcagcaucccuaacgacaaacccuuucagaaugucaaccgcauuacguauggcgcuuguccuagauacguuaagcagaauacccucaaacuggccacagggaugcggaacgugcccgagaagcaaacccgcggaaucuucggcgcgauugccggguuuaucgaaaauggaugggagggcaugguggaugggugguauggauucagacaccagaacuccgagggcaucggccaggcugccgaccuuaaaucuacacaagcugccauugaucagaucaaugggaagcugaaccggcucauuggaaaaaccaacgaaaaguuccaccagaucgagaaggaauuuagcgaggucgaaggccgcauucaggaccuggagaaauacguggaggauacgaagaucgaccuuugguccuauaaugccgaacugcucguugcucuggagaaccaacauacaauugaucugaccgacagcgaaaugaauaaacucuucgagaagaccaaaaagcagcugagagaaaacgcggaggauauggggaauggaugcuuuaagaucuaccacaaaugugacaacgccugcaucggcucuauucggaaugggacauaugaucaugacguguacagagacgaggcucuuaacaaucgcuuccagaucaagggcgucgaacugaaauccggauacaaggauuggauucucuggaucagcuuugccauuucuugcuuccugcuuuguguggcccugcucggcuuuaucaugugggcuugccagaaagggaacauccgguguaauauuugcaucuga

SEQ ID NO: 185283 - RNA, 1698 nt, Artificial Sequence
  derived and/or modified sequence opt5 from hemagglutinin__InfluenzaA__ABY51138
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagccggucuuacgcuaacaauaaggaaaaagaggugcugguccucuggggagugcaucacccuccgaacaucggcgaucagcgcgcccuguaccacacagaaaacgcuuauguguccgucguuagcucccauuacucuagacgguucacccccgagauugccaagcgcccuaaagugagagaccaggaagggcggaucaauuauuacuggacgcuucuggagcccggagauacaauuaucuuugaggcgaacggcaaucucauugccccucgcuucgcuuuugcccugagcagaggguucggauccggcaucauuaccagcaacgcucccauggacgaaugugaugccaagugccagacaccgcaaggcgcgaucaauucuucccuuccuuuucagaacgugcaccccgucaccaucggggaguguccuaaguaugugcggagcgccaaacugcgcaugguuaccggacucagaaauauucccucuauccagagccggggccuguucggggcuauugccggauuuaucgaaggcggguggacaggaaugguggacggcugguacggcuaucaucaccagaacgagcaaggguccggauacgcugccgaucagaagucuacgcagaaugccauuaacggcaucaccaauaaagucaacagcgugaucgaaaagaugaauacacaguucaccgcuguugggaaagaguucaacaagcuggagcgcagaauggaaaaucucaacaaaaagguggacgauggauuucuggacauuuggacauacaacgcggagcuucugguccuccuggaaaaugagcggacccuugacuuccacgauuccaacgugaagaaucuguaugaaaaagucaagauccaacucaaaaacaaugccaaggagauuggcaacgggugcuuugaguucuaccauaaauguaaugacgaaugcauggagagcgugaagaacggcacguaugauuaccccaaguauucugaagaguccaaacugaauagagagaagaucgacggaguuaaacuggaaagcaugggcguguaccagauucucgcuaucuauucuacagucgccuccagccuggugcuucugguuucccucggggccaucucuuuuuggaugugcagcaacggaucccugcagugucgcauuugcaucuga

SEQ ID NO: 185284 - RNA, 1698 nt, Artificial Sequence; identical to SEQ ID NO: 184938
  derived and/or modified sequence opt5 from hemagglutinin__InfluenzaA__ABY51149

SEQ ID NO: 185285 - RNA, 1698 nt, Artificial Sequence
  derived and/or modified sequence opt5 from hemagglutinin__InfluenzaA__ABY51160
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauagacacaacgggaaacuuugccugcucaagggaaucgcgccccugcagcugggcaauuguucuguugcuggguggauucucggaaacccugagugcgaacugcuuaucagcaaagaguccuggucuuacauuguggaaaccccgaaucccgagaacggcacguguuauccuggguacuuugccgacuaugaggaacugcgggagcaacucagcuccgucucuagcuucgaacgcuuugagaucuuccccaaggaguccagcuggccuaaucauaccgugacaggaguuucugccuccugcagccacaacggcaagucuuccuuuuacagaaaucugcuuuggcugaccggcaaaaacgggcucuaucccaaucugagcaagucuuacgcuaacaauaaagaaaaggaggugcugguccucuggggagugcaucacccuccgaacaucggcgaucagcgggcccuguaccacacagaaaacgcuuauguguccgucguuagcucccauuacucucgcagauucacccccgagauugccaaacggccuaaggugcgcgaccaggaagggagaaucaauuauuacuggacgcuucuggagcccggagauacaauuaucuuugaggcgaacggcaaucucauugccccucgguucgcuuuugcccugagccgcggguucggauccggcaucauuaccagcaacgcucccauggacaagugugaugccaaaugccagacaccgcaaggcgcgaucaauucuucccuuccuuuucagaacgugcaccccgucaccaucggggaauguccuaaguaugugagaagcgccaaacugcggaugguuaccggacuccgcaauauucccucuauccagagcagaggccuguucggggcuauugccggauuuaucgagggcggguggacaggaaugauugacggcugguacggcuaucaucaccagaacgaacaaggguccggauacgcugccgaucagaagucuacgcagaaugccaucaacggcaucaccaauaaagugaacagcgucauugagaagaugaauacacaguucaccgcuguggggaaagaguucaacaagcuggaacggcgcauggagaaucucaacaagaaaguugacgauggauuucuggacaucuggacauacaacgcggaacuucuggugcuccuggagaaugaaagaacccuugacuuccacgauuccaacgucaagaaucuguaugagaaagucaagagccaacucaaaaacaaugccaaggaaauuggcaacgggugcuuugaguucuaccauaaguguaaugacgagugcauggaaucugugaaaaacggcacguaugauuaccccaaguauuccgaggaaagcaaacugaaucgggagaagaucgacggagugaaacuggagucuaugggcguuuaccagauucucgcuaucuauuccacaguggccagcucccugguccuucuggugucucucggggccaucagcuuuuggaugugcuccaacggaucucugcaguguagaauuugcaucuga

SEQ ID NO: 185286 - RNA, 1698 nt, Artificial Sequence
  derived and/or modified sequence opt5 from hemagglutinin__InfluenzaA__ABY51171
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccaugggcgaaugugacgccaagugccagacaccgcaaggggcgaucaauuccagccuuccuuuucagaacgugcaccccgucaccaucggagaguguccuaaauaugugcgcucugccaagcugagaaugguuaccggccuccggaauauucccagcauccagucccgcgggcuguucggagcuauugccggcuuuaucgaagggggauggacaggcaugguggauggcugguacggguaucaucaccagaacgagcaaggaucuggcuacgcugccgaccagaaaagcacgcagaaugccauuaacgggaucaccaauaaggucaacuccgugaucgaaaagaugaauacacaguucaccgcuguuggaaaagaguucaacaaacuggagagacggauggaaaaucucaacaagaagguggaugacggcuuucuggauauuuggacauacaacgcggagcuucugguccuccuggaaaaugagcgcacccuugacuuccacgacagcaacgugaaaaaucuguaugaaaaggucaaaucucaacucaagaacaaugccaaagagaucgggaacggcugcuuugaguucuaccauaaguguaaugaugaaugcauggaguccgugaagaacggaacguaugacuaccagaaauauagcgaagagucuaagcugaauagagagaaaauugauggcguuaagcuggaauccauggggguguaccagauccucgcuauuuauagcacagucgccuccucucuggugcuucugguuagccucggagccaucuccuuuuggaugugcucuaacggcagccugcaaugucggaucugcauuuga

SEQ ID NO: 185287 - RNA, 1698 nt, Artificial Sequence; identical to SEQ ID NO: 184934
  derived and/or modified sequence opt5 from hemagglutinin__InfluenzaA__ABY51182

SEQ ID NO: 185288 - RNA, 1698 nt, Artificial Sequence; identical to SEQ ID NO: 184954
  derived and/or modified sequence opt5 from hemagglutinin__InfluenzaA__ABY51193

SEQ ID NO: 185289 - RNA, 1698 nt, Artificial Sequence; identical to SEQ ID NO: 184938
  derived and/or modified sequence opt5 from hemagglutinin__InfluenzaA__ABY51237

SEQ ID NO: 185290 - RNA, 1698 nt, Artificial Sequence; identical to SEQ ID NO: 184954
  derived and/or modified sequence opt5 from hemagglutinin__InfluenzaA__ABY51248

SEQ ID NO: 185291 - RNA, 1698 nt, Artificial Sequence; identical to SEQ ID NO: 184934
  derived and/or modified sequence opt5 from hemagglutinin__InfluenzaA__ABY51259

SEQ ID NO: 185292 - RNA, 1701 nt, Artificial Sequence; identical to SEQ ID NO: 185011
  derived and/or modified sequence opt5 from hemagglutinin__InfluenzaA__ABY51270

SEQ ID NO: 185293 - RNA, 1707 nt, Artificial Sequence
  derived and/or modified sequence opt5 from hemagglutinin__InfluenzaA__ABY76282
auggagaagaucgugcugcuccuggccauugucagccuuguuaaauccgaccagaucugcauuggcuaccacgcuaacaauucuaccgaacauguggauacaaucauggagaagaacgugacggucacccacgcccaagacauucuggaaaaagcgcauaaugggagacucugugaucuggacggagugaagccccuuauccugcgggauugcagcguugcuggcuggcuccuggggaacccuaugugugacgaguuccugaaugugccggaaugguccuauaucgucgagaaaaacaaucccgccaacgaucucugcuacccuggaaauuuuaacgacuaugaggaacugaagcaccuucugucucgcauuaaucauuucgagaagauccagauuauccccaaaagcuccuggucugaucacgaagccagcuccggcgugagcucugcuuguccuuaccaggggagauccagcuuuuuccggaacguuguguggcucauuaagaaaaaugacgccuaucccacaaucaagcgcucuuacaacaauaccaaccaggaggaucugcuuguccuguggggcauucaccauccuaacgacgcugccgagcaaacaagacucuaucagaauccgaccacauacaucuccgugggaaccagcacgcugaaccagcggcuggugcccaaaaucgcgacccgcucuaaggucaauggccaguccgggagaauggaauuuuucuggacaauucucaagccuaacgaugccaucaauuuugagagcaacggaaauuucauugcucccgaaaacgccuacaaaaucguuaagaaaggcgacuccaccauuaugaagucugagcuggaauaugggaauugcaacacaaaaugucaaaccccuaucggagcuaucaauagcuccaugcccuuucacaacauucauccgcuuacgaucggcgagugcccuaaguacgugaaaagcaaucggcuggugcucgccacagggcugcgcaacucuccccagggagagagacggcgcaagaagagaggccuuuucggcgcgauugccggguuuaucgaaggaggcuggcaggggauggucgacggaugguauggcuaccaccacuccaaugagcaggggagcggauaugcugccgauaaagaaucuacccaaaaggcuauugacggcgugacaaacaaaguuaacagcaucaucgauaagaugaauacccaguucgaggccgugggccgggaauuuaacaaucuggagcgcagaauugagaaccucaauaaaaagauggaagacggguuccuggaugucuggaccuacaacgccgagcugcucgugcugauggaaaaugagcggacacuugacuuccaugauuccaacguuaagaaucuguaugacaaagugagacuccagcugcgcgauaacgcuaaggaacuuggaaauggcuguuuugaguucuaccaccggugcgacaacgaguguauggaaucugucagaaaugggacguacgauuauccucaauacagcgaggaagcgcgccugaaacgggaggagaucuccggagugaagcucgaaagcauuggcaccuaucagauccugucuauuuacuccacagucgccagcucucuggcucucgccaucaugguggccgggcugucccuuuggaugugcagcaacggcucccugcagugcagaauuuguaucuga

SEQ ID NO: 185294 - RNA, 1701 nt, Artificial Sequence
  derived and/or modified sequence opt5 from hemagglutinin__InfluenzaA__ABY81349
augaaggccaaacugcucgugcugcuuugcgcucugagcgccaccgacgcggauacaaucuguauuggcuaccacgcuaacaauuccacggacaccgucgauacaguucucgagaagaacgugaccgugacacauucugucaaucugcuugaagacagccacaacgggaaacugugcagacucaagggaaucgcuccccugcagcugggcaaauguuccauugccggguggauccucggaaauccugagugcgaaucucuguucagcaagaaguccuggucuuauauugccgagaccccgaacagcgaaaauggcacauguuaccccggguauuuugccgauuacgaggagcuucgggaacaacuguccagcgugucuuccuucgagcgcuuugaaaucuucccuaaagagagaagcuggcccaagcauaacguuacccggggagugacggcugccugcucucacaaaggcaaguccagcuuuuaucgcaaucuccuguggcuuaccgagaaaaacggcucuuacccuaaucuguccaagagcuaugucaacaauaaggaaaaagaggugcucguucuguggggagugcaucaccccuccaacaucaaggaccagaaaacaauuuaccagaaggaaaaugcguacgucucuguggugagcuccaacuauaacagacgguucaccccugagaucgccaaacgcccgaaggucagagaucaggaagggcggauuaauuacuauuggacacugcucgagcccggcgacaccaucauuuuugaggcuaacgggaaucugaucgccccuugguacgcuuucgcccuuagccgcggauuuggcucugggauuaucacguccaacgcgagcauggaugaaugugacacaaaaugccaaacaccccagggagccaucaauucuagccugccuuuccagaacguucaccccgugaccauuggcgaguguccgaaguaugugagauccaccaagcuccggauggucaccggccugcgcaauaucccuucuauucagagcagagggcuuuuuggagcuaucgccggcuucauugaagggggauggacaggcaugaucgaugggugguacggauaucaucaccaaaacgagcagggcuccggcuacgcugccgaccagaaaagcacgcagaaugccaucaacgggauuaccaauaaggugaacucuguuaucgaaaagaugaauacacaauuuaccgcugugggaaaggaguucaacaaacuggagaagcggauggaaaaucucaacaagaaagucgaugacggcuuccuggacauuuggacauacaacgcggagcugcucgugcugcuugaaaaugagcgcacccuggauuuucaugacuccaacguuaagaaucucuaugaaaaagugaaaagccagcugaaaaacaaugccaaggaggucgggaacggaugcuucgaguuuuaccacaaguguaauaacgaaugcauggagucugugaaaaauggcacguaugauuaccccaaguauuccgaagagagcaaacuuaacagagagaagaucgacggggucaaacuggaauccaugggcguguaccagauucucgcuaucuauucuacaguugccagcucccuggugcugcucgucucucugggagccaucagcuucuggaugugcuccaauggcagccuucaaugucggauuugcaucuga

SEQ ID NO: 185295 - RNA, 1701 nt, Artificial Sequence; identical to SEQ ID NO: 184952
  derived and/or modified sequence opt5 from hemagglutinin__InfluenzaA__ABY81371

SEQ ID NO: 185296 - RNA, 1698 nt, Artificial Sequence; identical to SEQ ID NO: 184938
  derived and/or modified sequence opt5 from hemagglutinin__InfluenzaA__ABY81382

SEQ ID NO: 185297 - RNA, 1698 nt, Artificial Sequence; identical to SEQ ID NO: 184980
  derived and/or modified sequence opt5 from hemagglutinin__InfluenzaA__ABY81393

SEQ ID NO: 185298 - RNA, 1698 nt, Artificial Sequence
  derived and/or modified sequence opt5 from hemagglutinin__InfluenzaA__ABY81415
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgucccccgagaauggcacguguuauccuggguacuuugccgacuaugaggaacugagagagcaacucucuagcgucuccagcuucgaacgguuugagaucuuccccaaggagucuuccuggccuaaccauaccgugacaggaguuagcgccucuugcucccacaauggcaagagcucuuuuuaccgcaaccugcuuuggcugaccggcaaaaaugggcucuaucccaaccuguccaagagcuacgcuaauaacaaagaaaaggaggugcugguccucuggggagugcaucacccuccgaauaucggcgaucagagagcccuguaccacacagaaaacgcuuauguguccgucguuucuagccauuacucccggcgcuucacccccgagauugccaaaagaccuaaggugcgggaccaggaagggcgcaucaacuauuacuggacgcuucuggagcccggagauacaauuaucuuugaggcgaauggcaaccucauugccccuagauucgcuuuugcccugagccggggguucggaucuggcaucauuaccuccaaugcucccaugggcgaaugugacgccaagugccagacaccgcaaggggcgaucaacagcucucuuccuuuucagaaugugcaccccgucaccaucggagaguguccuaaauaugugcgcagcgccaagcugagaaugguuaccggccuccggaacauucccuccauccagucucgcgggcuguucggagcuauugccggcuuuaucgaagggggauggacaggcaugguggauggcugguacggguaucaucaccagaaugagcaaggaagcggcuacgcugccgaccagaaauccacgcagaacgccauuaaugggaucaccaacaaggucaauagcgugaucgaaaagaugaacacacaguucaccgcuguuggaaaagaguucaauaaacuggagagacggauggaaaaccucaauaagaagguggaugacggcuuucuggauauuuggacauacaacgcggagcuucugguccuccuggaaaacgagcgcacccuugacuuccacgacucuaaugugaaaaaccuguaugaaaaggucaaaucccaacucaagaauaacgccaaagagaucgggaauggcugcuuugaguucuaccauaaguguaacgaugaaugcauggagagcgugaagaauggaacguaugacuaccccaaauauucugaagaguccaagcugaacagagagaaaauugauggcguuaagcuggaaagcauggggguguaccagauccucgcuauuuauuccacagucgccucuagccuggugcuucugguuucccucggagccaucucuuuuuggaugugcagcaauggcucccugcagugucggaucugcauuuga

SEQ ID NO: 185299 - RNA, 1701 nt, Artificial Sequence; identical to SEQ ID NO: 184952
  derived and/or modified sequence opt5 from hemagglutinin__InfluenzaA__ACA24502

SEQ ID NO: 185300 - RNA, 1698 nt, Artificial Sequence
  derived and/or modified sequence opt5 from hemagglutinin__InfluenzaA__ACA24513
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucaauuccgugucuagcuucgaacgguuugagaucuuccccaaggaguccagcuggccuaaccauaccgucacaggagugucugccuccugcagccacaauggcaagucuuccuuuuaccgcaaccugcuuuggcugaccggcaaaaaugggcucuaucccaaccugagcaagucuuacgcuaauaacaaagaaaaggagguucuggugcucuggggaguccaucacccuccgaacauuggcgaucagagagcccuguaccacacagaaaaugcuuauguguccguggucagcucccauuacucucggcgcuucacccccgagaucgccaaaagaccuaagguucgggaccaggaagggcgcauuaacuauuacuggacgcuucuggagcccagagauacaaucauuuuugaggcgaauggaaaccucaucgccccucgguucgcuuuugcccugagccgcggcuucggguccggaauuaucaccagcaaugcucccauggacgaaugugaugccaagugccagacaccgcaaggcgcgaucaacucuucccuuccuuuucagaaugugcaccccgugaccauuggcgaguguccuaaauaugucagaagcaccaagcugcggauggugacagggcuccgcaacauccccucuauucagagcagaggacuguucggcgccaucgcuggguuuauugaaggaggcuggacggggaugguugacggaugguacggcuaucaucaccagaaugagcaaggcuccggguacgccgcugaucagaaaucuacccagaacgccaucaauggaaucacaaacaaggugaauagcgucauugaaaagaugaacacccaguucacagccgugggcaaagaguucaauaaacuggagcggcgcauggaaaaccucaacaagaagguugacgauggguuucuggacaucuggaccuacaaugcugagcuucuggugcuccuggaaaacgagagaacgcuugacuuccacgauuccaaugucaaaaaccuguaugaaaaggugaaaagccaacucaagaauaacgcgaaagagauuggaaauggcugcuuugaguucuaccauaaguguaacgacgaaugcauggagucugucaagaaugggacauaugauuaccccaaauauuccgaagagagcaagcugaaccgggagaaaaucgacggcgugaagcuggaaucuaugggaguuuaccagauucucgccaucuauuccaccguggcuagcucccugguccuucuggugucucucggcgccaucagcuuuuggaugugcuccaaugggucucugcaguguagaauuugcaucuga

SEQ ID NO: 185301 - RNA, 1698 nt, Artificial Sequence; identical to SEQ ID NO: 184938
  derived and/or modified sequence opt5 from hemagglutinin__InfluenzaA__ACA24524

SEQ ID NO: 185302 - RNA, 1701 nt, Artificial Sequence
  derived and/or modified sequence opt5 from hemagglutinin__InfluenzaA__ACA24689
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauuaucgauggagagaauuguacccuuauugacgcccugcucggcgauccccagugcgacggguuucaaaacaaaaagugggaucuguucgucgaaagaucuaaagccuauagcaauuguuacccuuaugacgugcccgauuacgcuucccugcggucucucguugccagcuccggaacgcuggaguuuaacaaugaaucuuucaacuggaccggcgugacacagaauggcaccucuuccgcuugcaagcgcgggagcaacaauagcuuuuucuccagacuuaacuggcugacacauagcaaguuuaaauauccugcccucaaugucaccaugcccaacaacgaggaguucgacaagcuguacaucuggggagugcaccauccuggcacggauaaugaccagauuuuucuuuaugcgcaggccucugggcggaucacaguuuccaccaaacgcagccaacagacagugauuccgaacaucggauccagaccccggguccgcaauaucccuucuagaauuagcaucuacuggaccauugugaagcccggcgauauccugcucauuaacuccaccgggaaucugaucgcuccucggggauacuucaaaauccgcagcggcaagucuuccauuaugagaagcgacgcccccaucggcaaguguaacucugaaugcauuacaccgaaugggagcaucccuaacgacaaacccuuucagaaugugaaccggauuacguauggagcuuguccucgcuacgucaagcagaauacccugaaacucgccacaggcaugagaaacguucccgagaagcaaacccgggggaucuucggagcgaucgccggcuuuauugaaaaugggugggagggaaugguggauggcugguauggcuuccgccaccagaacuccgaggggaucggacaggcugccgaccugaaaucuacacaagcugccauugaucagaucaauggcaaacuuaacagacugauugggaagaccaacgaaaaguuccaccagaucgagaaggaauuuagcgagguggaaggacggauucaggaccucgagaaauacgucgaggauacgaagaucgaccugugguccuauaaugccgaacuucugguggcucucgagaaccaacauacaaucgaucugaccgacagcgaaaugaauaaacuguucgagaagaccaaaaagcagcucagagaaaacgcggaggauaugggcaaugggugcuuuaagauuuaccacaaaugugacaacgccugcaucggcucuauucgcaauggaacauaugaucauuacguuuaccgggacgaggcucugaacaauagauuccagaucaagggcauugaacuuaaauccggguauaaggacuggauccuguggaucagcuuugccauuucuugcuuccuccuguguguggcccuucugggauuuaucaugugggcuugccagaaaggcaacauucgcuguaauaucugcauuuga

SEQ ID NO: 185303 - RNA, 1701 nt, Artificial Sequence
  derived and/or modified sequence opt5 from hemagglutinin__InfluenzaA__ACA24700
augaagaccaucauugcccugagcuacauccucugccugguguucgcucagaaacuucccggcauugacaacuccacagccacgcugugucucgggcaccaugcggucccuaauggaaccaucguuaagacaauuaccaacgaucaaaucgaggugacaaaugcuaccgaacuggugcagaacucuagcacaggcgggaucugcgacuccccgcaccagauucuugauggagagaauuguacccugaucgacgcccuccugggcgauccccagugcgacggguuucaaaacaaaaagugggaucuguucgucgaaagaucucaggccuauagcaauuguuacccuuaugacgugcccgauuacgcuucccuccggucucugguugccagcuccggaacgcuugaguuuaacaaugaaucuuucaacuggaccggcgugacacagaauggcaccucuuccgcuugcaaacgcgggagcaacaauagcuuuuucuccagacugaacuggcucacacauagcaaguuuaaguauccugcccugaaugucaccaugcccaacaacgaggaguucgacaaacuuuacauuuggggagugcaccauccuggcacggauaaugaccagaucuuucuguaugcgcaagccucugggcggauuacaguuuccaccaagcgcagccagcagacagugaucccgaacauuggauccagaccccggguccgcaauaucccuucuagaaucagcauuuacuggaccaucgugaaacccggcgauauucuccugaucaacuccaccgggaaucugauugcuccucggggauacuucaagauccgcagcggcaaaucuuccaucaugagaagcgacgcccccauuggcaaguguaacucugaaugcaucacaccgaaugggagcauuccuaacgacaagcccuuucagaaugugaaccggaucacguauggagcuuguccucgcuacgucaaacaaaauacccucaagcuggccacaggcaugagaaacguucccgagaaacagacccgggggauuuucggagcgaucgccggcuuuaucgaaaaugggugggagggaaugguggauggcugguauggcuuccgccaccagaacuccgaggggauuggacaagcugccgaccuuaagucuacacaggcugccaucgaucagauuaauggcaaacugaacagacucaucgggaagaccaacgaaaaauuccaccagauugagaaggaauuuagcgagguggaaggacggauccaagaccuggagaaguacgucgaggauacgaaaauugaccuuugguccuauaaugccgaacugcucguggcucuggagaaccagcauacaaucgaucugaccgacagcgaaaugaauaaacucuucgagaagaccaagaaacagcugagagaaaacgcggaggauaugggcaaugggugcuuuaagaucuaccacaagugugacaacgccugcauuggcucuauccgcaauggaacauaugaucaugacguuuaccgggacgaggcucuuaacaauagauuccagauuaaaggcguggaacugaaguccggguacaaagauuggauccucuggauuagcuuugccaucucuugcuuccugcuuugugucgcccugcucggauuuaucaugugggcuugccaaaagggcaacauucgcuguaauaucugcauuuga

SEQ ID NO: 185304 - RNA, 1698 nt, Artificial Sequence
  derived and/or modified sequence opt5 from hemagglutinin__InfluenzaA__ACA28846
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcauucagaaagcccuguaccauaccgagaaugcuuacgugagcgucguuuccucucacuauagcagaaaguucacacccgaaaucgccaagcggccuaaagugcgcgaccaggaggggagaauuaacuacuauuggacccuucuggagcccggagauacgaucauuuuugaagcgaauggcaaccucaucgccccucgguacgcuuucgcccugucccgcggguuuggaagcggcauuaucaauucuaacgcucccauggacaagugugaugccaaaugccagacaccgcaaggcgcgaucaauuccagccuuccuuuccagaacgugcaucccgucaccauuggggaguguccuaaguaugugagaucugccaaacugcggaugguuacaggacuccgcaauauccccagcauucaguccagaggccuguuuggggcuaucgccggauucauugaaggcggguggaccggaaugguggacggcugguacggcuaucaccaccagaacgagcaagggucuggauacgcugccgaucaaaagagcacccagaaugccaucaacggcaucacaaauaaagucaacuccgugauugaaaagaugaauacgcaguuuaccgcuguugggaaggaguucaacaaacuggagcggcgcauggaaaaccucaauaagaaaguggacgauggauucaucgacauuuggacauacaacgcggagcugcuuguccugcucgaaaaugagagaacccuggauuuucaugacagcaacgugaagaaucuuuaugaaaaagucaagucucagcugaagaacaaugccaaagagaucggcaacgggugcuucgaguuuuaccacaaguguaaugacgaaugcauggaguccgugaaaaacggcacauaugauuaccccaaguauagcgaagagucuaaacucaaucgggagaagauugacggaguuaagcuggaauccaugggcguguaccagauccuggcuaucuauagcaccgucgccuccucucucgugcugcuuguuagccugggggccauuuccuucuggaugugcucuaacggaagccuccagugucgcaucugcauuuga

SEQ ID NO: 185305 - RNA, 1701 nt, Artificial Sequence
  derived and/or modified sequence opt5 from hemagglutinin__InfluenzaA__ACA33749
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcucuugcauccgcagauccaacaauagcuuuuucucucggcugaacuggcucacacaucugaaguuuaaguauccugcucuuaaugucaccaugcccaacaacgagaaauucgacaagcuguacauuuggggcgugcaccauccugggacggauaaugaccagaucuuucucuaugcccaggcguccggacgcauuacaguuagcaccaaaagaucccaacagacagugaucccgaacauuggcucucggccccgcgucagaaauaucccuagccggaucuccauuuacuggaccaucgugaagcccggggauauucugcugaucaacagcaccggaaaucucauugccccucgcggcuacuucaaaaucagaucugggaaguccagcaucaugcggucugacgcucccauuggaaaguguaacagcgaaugcaucacaccgaauggcuccauuccuaacgacaaacccuuucagaaugugaaccgcaucacguauggcgccuguccuagauacgucaagcagaauacccugaaacuugcuacagggaugcggaacguucccgagaagcaaacccgcggaauuuucggcgccaucgcgggguuuaucgaaaauggaugggagggcaugguggaugggugguauggauucagacaccagaacucugagggcauuggccaggccgcugaccugaaaagcacacaagccgcuaucgaucagauuaaugggaagcucaaccggcugaucggaaaaaccaacgaaaaguuccaccagauugagaaggaauuuuccgagguggaaggcagaauccaggaccuugagaaauacgucgaggauacgaagauugaccuguggagcuauaaugccgaacuccugguggcccuggagaaccaacauacaaucgaucucaccgacucugaaaugaauaaacuguucgagaagaccaaaaagcagcuucgcgaaaacgcugaggauauggggaauggaugcuuuaagaucuaccacaaaugugacaacgcgugcauuggcuccauccggaaugggacauaugaucaugacguuuacagagacgaggcccugaacaaucgcuuccagauuaagggcguggaacucaaaagcggauacaaggauuggauccuguggauuucuuuugcuaucuccugcuuccuucugugugucgcccuccugggcuuuaucaugugggccugccagaaagggaacauucgguguaauaucugcauuuga

SEQ ID NO: 185306 - RNA, 1698 nt, Artificial Sequence; identical to SEQ ID NO: 184934
  derived and/or modified sequence opt5 from hemagglutinin__InfluenzaA__ACA96519

SEQ ID NO: 185307 - RNA, 1659 nt, Artificial Sequence
  derived and/or modified sequence opt5 from hemagglutinin__InfluenzaA__ACC55270
augaacacccagauccuggccuucauugcuugcgugcucacaggcgucaagggggacaaaaucugucugggacaccaugccguugcgaauggcacgaaggugaacacccuuacagagagagggauugaaguggucaaugcuaccgagacaguggaaaccacaaacaucaaaaagauuugcacccaaggaaaacggcccacggaucugggccagugugggcuccugggaacccuuaucggcccuccgcagugcgaccaguuucuggaguucagcuccgaucucaucauugaacgcagagagggcacagacaucuguuaccccgggcgguuuaccaaugaggaaucucugcgccaaauucugagacggagcggaggcaucgggaaggaguccaugggauucacauauucuggcauucgcaccaacggggccacgagcgccugcacaagauccggaucuagcuuuuacgcugaaaugaaguggcuccuguccaauagcgauaacgccgcuuucccucagaugaccaaagccuaucggaauccccgcaacaagccugcgcuuaucauuuggggcguucaccauucugaguccgugagcgagcagacaaaacuguacggcucugggaauaagcucaucaccgucagauccagcaaauaucagcaaucuuuuacccccaacccuggagcccggcgcaucgacuuccacuggcugcuucuggauccgaaugacacagugacguuuaccuucaacggcgcuuuuauugcccccgauagaacauccuucuuucgcggggaaagccucggaguucaguccgacgcuccucuggauucuagcugucggggcgacugcuuccauuccgggggaaccaucgugagcucucugcccuuccagaauauuaacuccagaacagucggcaaguguccucgguacgugaagcagaaaagccuccugcuugccaccggcaugagaaacgugcccgagaagccgaaaccucgcgggcuguuuggagcgaucgccggcuucauugaaaaugggugggagggacucaucaacggcugguauggguuucggcaccaaaaugcucagggcgaaggaacggccgcugauuacaagucuacacagagcgccaucgaccaaauuaccggcaaacugaacagacuuaucgggaagaccaaucagcaguucgagcugauugacaacgaguuuaaugaaaucgagcagcaaauuggaaacgucaucaauuggacacgcgaugccaugaccgaaaucugguccuacaacgcugagcuccugguugcgauggaaaaucagcacacaauugaccuggccgauucugagaugagcaaacucuaugagcgggugaagaagcagcugagagaaaacgcugaggaagacggcacggggugcuucgagaucuuucauaaaugugaugaccagugcauggaauccauucgcaauaacaccuacgaucacacacaauaucggaccgagagccuucagaauagaauccagauugaccccgugaagcugucuuccggauacaaagauaucauucucugguucagcuuuggcgccucuugcuuccugcuucuggccaucgcuauggggcucgucuuuaucuguauuaagaacggcaacaugcagugcacaaucuguauuuga

SEQ ID NO: 185308 - RNA, 1698 nt, Artificial Sequence; identical to SEQ ID NO: 184938
  derived and/or modified sequence opt5 from hemagglutinin__InfluenzaA__ACC61964

SEQ ID NO: 185309 - RNA, 1698 nt, Artificial Sequence
  derived and/or modified sequence opt5 from hemagglutinin__InfluenzaA__ACC61975
augaaggugaaacugcucguccugcuuugcaccuucacagccagcuacgcugacacgaucuguauuggcuaucacgccaacaauuccaccgauacaguugacaccgugcuggagaagaacgugacagucacccauucugugaaucuccuggaagauagccacaacgggaaacuuugccugcucaagggaaucgcgccccugcagcugggcaauuguuccguugcuggguggauucucggaaacccugagugcgaacugcuuaucucuaaagagagcugguccuacauuguggaagucccgaaucccgagaacggcacauguuauccuggguacuuugccgacuaugaggaacugagagagcaacucucuagcaucuccagcuucgaacgguuugagaucuuccccaaggagucuuccuggccuaaucauaccgugacgggaguuagcgccucuugcucccacaacggcaagagcucuuuuuaccgcaaucugcuuuggcugaccggcaaaaacgggcucuaucccaaucuguccaagagcuacgcuaacaauaaagaaaaggaggugcugguccucuggggagugcaucacccuccgaacauuggcgaucagagagcccuguaccacacagaaaacgcuuauguguccgucguuucuagccauuacucccggcgcuucacccccgagaucgccaaaagaccuaaggugcgggaccaggaagggcgcauuaauuauuacuggacacuucuggagcccggagauaccaucauuuuugaggcgaacggcaaucucaucgccccuagauucgcuuuugcccugagccgggggcuuggaucuggcauuaucacguccaacgcucccauggacgaaugugaugccaagugccagacaccgcaaggcgcgaucaauagcucucugccuuuccagaacgugcaccccgucaccauuggggaguguccuaaauaugugcgcagcgccaagcucagaaugguuacaggacugcggaauauccccuccauucagucucgcggccuguuuggggcuaucgccggauucauugaaggcggguggaccggaaugguggacggcugguacggcuaucaucaccagaacgagcaagggagcggauacgcugccgaucagaaauccacccagaaugccaucaacggcaucacaaauaaggucaacagcgugauugaaaagaugaauacgcaguuuaccgcuguugggaaagaguucaacaaacucgagagacggauggaaaaucugaacaagaagguggacgauggauuccuugacaucuggacauacaacgcggagcugcucguccugcuugaaaaugagcgcacccuggacuuucacgauucuaacgugaaaaaucucuaugaaaaggucaaaucccaacugaagaacaaugccaaagagauuggcaacgggugcuucgaguuuuaccauaaguguaauaacgaaugcauggagagcgugaagaauggcacauaugacuaccccaaauauucugaagaguccaagcugaacagagagaaaaucgauggaguuaagcucgaaagcaugggcguguaccagauucuggcuaucuauuccaccgucgccucuagccuugugcugcucguuucccugggggccaucucuuucuggaugugcagcaauggaucccugcagugucggauuugcaucuga

SEQ ID NO: 185310 - RNA, 1698 nt, Artificial Sequence; identical to SEQ ID NO: 184934
  derived and/or modified sequence opt5 from hemagglutinin__InfluenzaA__ACC61986

SEQ ID NO: 185311 - RNA, 1698 nt, Artificial Sequence
  derived and/or modified sequence opt5 from hemagglutinin__InfluenzaA__ACD37430
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuacccauacagucaccggaguguccgcuagcugcucucacaauggcaaguccagcuuuuaccgcaaccugcuuuggcugacaggcaaaaaugggcucuaucccaaccugucuaaguccuacguuaauaacaaagaaaaggaggugcugguccucuggggagugcaucacccuccgaauaucggcgaucagagagcccuguaccacaccgaaaacgcuuaugugagcgucguuuccucucauuacagccggcgcuucacgcccgagauugccaaaagaccuaaggugcgggaccaggaagggcgcaucaacuauuacuggacacuucuggagcccggagauaccauuaucuuugaggcgaauggcaaccucauugccccuugguaugcuuucgcccuguccagaggguuuggaagcggcaucauuacaucuaaugcucccauggacgaaugugaugccaagugccagaccccgcaaggcgcgaucaacuccagccuuccuuuccagaaugugcaccccgucaccaucggggaguguccuaaauacgugcggucugccaagcugcgcaugguuacaggacucagaaacauucccagcauccagucccggggccuguuuggggcuauugccggauucaucgaaggcggguggacgggaaugguggacggcugguauggcuaccaucaccagaaugagcaagggucuggauacgcugccgaucagaaaagcacccagaacgccauuaauggcaucacaaacaaggucaauuccgugaucgaaaagaugaacacccaguuuacagcuguugggaaagaguucaauaaacuggagcgcagaauggaaaaccucaauaagaagguggacgauggauuccuggacauuuggaccuauaacgcggagcuucugguccuccuggaaaacgagcggacgcuugacuuucacgauagcaaugugaaaaaccuguacgaaaaggucaaaucucaacucaagaauaacgccaaagagaucggcaaugggugcuucgaguuuuaucauaaguguaacaaugaaugcauggaguccgugaagaacggcacauacgacuaucccaaauacagcgaagagucuaagcugaaucgcgagaaaauugauggaguuaagcuggaauccaugggcguguaucagauccucgcuauuuacagcaccgucgccuccucucuggugcuucugguuagccucggggccaucuccuucuggaugugcucuaacggaagccugcaguguagaaucugcauuuga

SEQ ID NO: 185312 - RNA, 1698 nt, Artificial Sequence
  derived and/or modified sequence opt5 from hemagglutinin__InfluenzaA__ACD37507
augaaggccaaacugcucgugcugcuuugcaccuucgcugccacauacgcggacacgaucuguauuggcuaucacgcuaacaauagcaccgauacagucgacaccguucuggagaagaacgugacagugacccauuccgucaaucuccuggaaaacucucacaaugggaaacuuugccugcucaagggaaucgcuccccugcagcugggcaacuguagcguggccggguggauucucggaaauccugagugcgaacugcuuaucuccaaagagucuuggagcuacauuguugaaaagccgaaccccgagaauggcacauguuauccugggcauuuugccgauuacgaggaacugagagagcaacucuccucugugagcuccuucgaacgguuugagaucuuccccaaggagagcucuuggccuaaccacaccgucacgggaguguccgccagcugcucucauaauggcgaauccagcuuuuaucgcaaccugcuuuggcugaccggcaaaaaugggcucuaccccaaccugucuaaguccuaugcuaauaacaaagagaaggaaguucuggugcucuggggaguccaccacccuccgaacaucggcaaucagaaagcccuguaccauacagagaacgcguacgugagcguggucuccucucacuauagcagaaaguucacccccgaaauugccaagcggccuaaaguucgcgaccaggaggggagaaucaauuacuauuggacacuucuggagcccggagauaccauuaucuuugaagcuaacggcaaucucauugccccucgguacgcuuucgcccugucccgcggguuuggaagcggcaucauuaacucuaaugcgcccauggacaagugugaugccaaaugccagacgccgcaaggcgcuaucaacuccagccuuccuuuccagaaugugcaucccgugacaaucggggaguguccuaaguaugucagaucugccaaacugcggauggugaccggacuccgcaacauucccagcauccaguccagaggccuguuuggggcuauugccggauucaucgaaggcggguggacaggaaugguugacggcugguacggcuaucaccaccagaaugagcaagggucuggauacgccgcugaucagaaguccacccagaacgcgauuaauggcaucaccaacaaagugaauagcgucaucgaaaagaugaacacacaguuuacggccguggggaaggaguucaacaaacuggagcggcgcauggaaaaucucaacaagaaaguugacgauggauucauugacaucuggaccuacaaugcugagcugcuugugcugcucgaaaacgagagaacacuggauuuucaugacagcaaugucaagaaccuuuaugaaaaagugaagucucaacugaagaauaacgccaaagagauuggcaaugggugcuucgaguuuuaccacaaguguaacgacgaaugcauggaguccgucaaaaauggcaccuaugauuaccccaaguauagcgaagagucuaaacucaaccgggagaagaucgacggagugaagcuggaauccaugggcguuuaccagauucuggccaucuauagcacaguggcuuccucucucguccugcuugugagccugggggccaucuccuucuggaugugcucuaauggaagccuccagugucgcauuugcaucuga

SEQ ID NO: 185313 - RNA, 1698 nt, Artificial Sequence; identical to SEQ ID NO: 185079
  derived and/or modified sequence opt5 from hemagglutinin__InfluenzaA__ACD56113

SEQ ID NO: 185314 - RNA, 1698 nt, Artificial Sequence; identical to SEQ ID NO: 184938
  derived and/or modified sequence opt5 from hemagglutinin__InfluenzaA__ACD56124

SEQ ID NO: 185315 - RNA, 1701 nt, Artificial Sequence; identical to SEQ ID NO: 185011
  derived and/or modified sequence opt5 from hemagglutinin__InfluenzaA__ACD56258

SEQ ID NO: 185316 - RNA, 1701 nt, Artificial Sequence; identical to SEQ ID NO: 184753
  derived and/or modified sequence opt5 from hemagglutinin__InfluenzaA__ACD56269

SEQ ID NO: 185317 - RNA, 1698 nt, Artificial Sequence
  derived and/or modified sequence opt5 from hemagglutinin__InfluenzaA__ACD56280
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccggcaacgggacguguuauccuggauacuuugccgacuaugaggagcugagagaacaacucuccucugugagcuccuucgagcgguuugaaaucuuccccaaggagagcucuuggccuaaucauaccgucacaggcguguccgccagcugcucucacaacggcaaguccagcuuuuaccgcaaucugcuuuggcugaccgggaaaaacggacucuaucccaaucugucuaaguccuacgcuaacaauaaagagaaggaaguucuggugcucuggggcguccaucacccuccgaacauuggggaucagagagcccuguaccacacagagaacgcuuaugugagcguggucuccucucauuacagccggcgcuucacccccgaaaucgccaaaagaccuaagguucgggaccaggagggacgcauuaauuauuacuggacgcuucuggaacccggcgauacaaucauuuuugaggcgaacgggaaucucaucgccccuagauucgcuuuugcccugucccggggauucggcagcggcauuaucaccucuaacgcucccauggacgagugugaagccaagugccagacaccgcaaggggcgaucaauuccagccuuccuuuucagaacgugcaccccgugaccauuggagaguguccuaaauauguccgcucuaccaagcugagaauggugacaggccuccggaauauccccagcauucagucccgcgggcuguucggagccaucgcuggcuuuauugaagggggauggacgggcaugguugauggcugguacggguaucaucaccagaacgagcaaggaucuggcuacgccgcugaccagaaaagcacccagaaugccaucaacgggaucacaaauaaggugaacuccgucauugaaaagaugaauacccaguucacagccgugggaaaagaguucaacaaacuggagagacggauggaaaaucucaacaagaagguugaugacggcuuucuggauaucuggaccuacaacgcugagcuucuggugcuccuggaaaaugagcgcacgcuugacuuccacgacagcaacgucaaaaaucuguaugaaaaggugaaaucucaacucaagaacaaugcgaaagagauugggaacggcugcuuugaguucuaccauaaguguaaugaugaaugcauggaguccgucaagaacggaacauaugacuaccccaaauauagcgaagagucuaagcugaauagagagaaaaucgauggcgugaagcuggaauccauggggguuuaccagauucucgccaucuauagcaccguggcuuccucucugguccuucuggugagccucggagccaucuccuuuuggaugugcucuaacggcagccugcagugucggauuugcaucuga

SEQ ID NO: 185318 - RNA, 1689 nt, Artificial Sequence
  derived and/or modified sequence opt5 from hemagglutinin__InfluenzaA__ACD56324
auggccaucauuuaccugauccuccuguucaccgcugugagaggcgaccagauuugcaucggguaucacgccaacaauagcacagagaaggucgauacgauucuugaacggaacguuaccgugacacaugcgaaaaauauccuggagaagacccacaacggacgccucuguaaacugaauggcauucccccucuugaacugggggacugcuccauugcuggauggcuccugggcaacccggagugugauagacugcuccgggugcccgaauggucuuacaucauggagaaggagaauccucgcaacgggcugugcuaucccggaucuuuuaaugacuacgaagaacuuaaacaucugcucuccucugucaagcacuucgaaaaggugagaauccugccuaaagaucgguggacacaacauaccacaaccggcagcucccgcgccugugccguuucuggcaaccccagcuuuuucagaaauaugguguggcuuacgaagaaagaguccaacuauccugucgcuaaggggagcuacaauaacaccucuggagagcagaugcugaucauuuggggcgugcaccacccgaucgacgaaacagagcagcggacccucuaucagaauguugggacauacguguccgucggaaccagcacgcugaacaaacgcucuacacccgauauugccaccagaccuaaggugaacggccuggggucccggauggaauuuagcuggacacuccuggacaugugggauaccaucaauuucgagucuaccggaaaccuuaucgcucccgaauacggcuuuaagauuuccaaacgcggcagcuccgggaucaugaagacagagagaacgcuggagaauugcgaaaccaaaugucaaacaccucucggagccauuaacaccacacugcccuuccauaaugugcacccgcuuaccaucggcgagugcccuaaguaugucaaaucugaaaagcugguucucgcgacggggcugcggaacgugccccagauugagccucgcggacuguuuggcgccaucgcuggguucaucgaaggaggcuggcagggcaugguggacgggugguacggauaucaucacagcaaugaucagggcuccggguacgccgcugacaaagagagcacacaaaaggccuuugauggaauuaccaacaaggucaauucugugaucgagaaaaugaacacccaguucgaagcgguuggcaaggaguuuuccaaucucgaaagacggcuggagaaccuuaauaaaaagauggaagacggguuccuggacguguggacauauaacgccgagcuccugguccuuauggagaaugaaagaacccuggauuuccacgacagcaacgugaaaaaccucuacgauaagguucgcaugcagcugcgggacaaugugaaggagcugggcaacggauguuuugaguucuaucauaaaugcgaugacgaguguaugaauagcgucaagaacggcacauacgauuaccccaaauaugaggaagagagcaagcucaauagaaacgaaauuaaaggggugaagcuguccucuaugggagucuaccagauccuugcuauuuaugccacgguggcuggcagccugucccucgccaucaugauggccgggaucagcuuuuggaugugcucuaauggaucccugcaaugccgcauuuguaucuga

SEQ ID NO: 185319 - RNA, 1689 nt, Artificial Sequence
  derived and/or modified sequence opt5 from hemagglutinin__InfluenzaA__ACD85187
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagaccgcuggacacaacauaccacaaccggaggcuccaaggccugugccguuucuggcaaacccagcuuuuucagaaacaugguguggcuuacgaagaaggggccuaauuacccggucgcuaaaggauccuauaacaauaccagcggcgagcagaugcugaucauuuggggagugcaccaccccaaggaugaggccgaacagcgggcucucuaccaggagguugggacauacgugucugccuccaccagcacacugaacaaacgcucuaccccugaaaucgcggccagacccgaggucaauggccuggggucccggauggaauuuagcuggacgcuccuggacgugugggauacaauuaacuucgagucuaccggaaaucuuguggcuccugaguauggcuuuaagaucuccaaacgcggcagcuccgggaucaugaagacagaaggaacccugggcaacugcgagaccaaaugucaaacaccccucggggccauuaacacgacccugccguuccauaauguccacccucuuacaaucggagaaugccccaaguacguuaagucugagaaacuggugcucgcuaccggccugagaaacgugccucagauugaaagccgggggcuguuuggagccaucgcgggcuucauugagggcggguggcagggaauggucgacggcugguauggguaccaucacuccaaugaucagggaagcggcuaugccgcugacaaggagucuacacaaaaagccuuugaugggaucaccaacaagguuaauuccgugaucgagaaaaugaacacgcaguucgaggcugugggcaaggaauuuaauaaccucgagaagcgccuggaaaaucuuaacaaaaagauggaggacggauuccuggacgucuggacauacaaugccgagcuccuggugcuuauggaaaacgagagaacccuggauuuccacgacagcaauguuaaaaaccucuaugauaaggugcggaugcagcugcgcgacaaugucaaagaacugggcaacggguguuuugaguucuaccauaagugcgaugacgaguguaugaacucugugaagaauggaaccuacgauuaucccaaauacgaagaggaaagcaagcucaacagaaaugagauuaaaggcgucaagcuguccucuauggggguguaucagauccuugccauuuacgcuacaguugcgggaagccugucccucgccaucaugauggcuggcauuagcuuuuggaugugcucuaacgggucccugcaaugccggaucuguaucuga

SEQ ID NO: 185320 - RNA, 1689 nt, Artificial Sequence
  derived and/or modified sequence opt5 from hemagglutinin__InfluenzaA__ACD85198
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaggaacuuaagcaucugcucucuagcgucaagcacuucgaaaaagugaagauucugccuaaagacggauggacacaacauaccacaaccggcggcuccaaggccugugccguuucugggaaacccagcuuuuuccgcaacaugguguggcuuacgaagaagggaccuaauuacccggucgcuaaaagauccuauaacaauaccagcggcgagcagaugcugaucauuuggggagugcaccaccccacagaugaggccgaacagcgggcucucuaccaggagguugggaccuacgugucugccuccacaagcacccugaacaagcgcucuacgccugaaaucgcggccagacccgaggucaauggccugcggucccgcauggaauuuagcuggacacuccuggacgugugggauaccauuaacuucgagucuacagggaaucuuguggcuccugaguauggauuuaaaaucuccaagagaggcagcuccggcaucaugaaaaccgaagggacccugggaaacugcgagacaaagugucaaacgccccucggcgccauuaacaccacacugccguuccauaauguccacccucuuaccaucggggaaugccccaaauacguuaagucugagaagcuggugcucgcuacaggacugcggaacgugccucagauugaaagccgcggccuguuuggggccaucgcgggauucauugagggcggcuggcaggggauggucgacggaugguauggcuaccaucacuccaaugaucaggggagcggauaugccgcugacaaagagucuacccaaaaggccuuugauagaaucacgaacaaaguuaauuccgugaucgaaaagaugaacacacaguucgaggcugugggcaaagaauuuagcaaucucgagaagcggcuggaaaaccuuaauaagaaaauggaggacggguuccuggacgucuggaccuacaacgccgagcuccuggugcuuauggaaaaugagcgcacccugggcuuccacgauucuaacguuaagaaucucuaugacaaagugagaaugcagcugcgggauaacgucaaggaacugggaaauggcuguuuugaguucuaccauaaaugcgacgaugaguguaugaacagcgugaagaacgggacauacgacuaucccaaguacgaagaggaauccaaacucaagagaaaugagauuaaaggagucaagcugucuagcaugggcguguaucagauccuugccauuuacgcuaccguugcggggucccugagccucgccaucaugauggcuggaauuucuuuuuggaugugcuccaacggcagccugcaaugccgcaucuguaucuga

SEQ ID NO: 185321 - RNA, 1689 nt, Artificial Sequence
  derived and/or modified sequence opt5 from hemagglutinin__InfluenzaA__ACD85209
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgcagaagggauccaacuauccugucgcuaaaggcagcuacaauaacaccucuggggagcagaugcugaucauuuggggagugcaccacccgaaugacgagacagaacagcggacccucuaucaaaacguuggcacauacguguccgucgggaccagcacgcugaauaagcgcucuacacccgauaucgccaccagaccuaaggugaacggacagggcggccggauggaguuuuccuggacacugcucgacaugugggauaccauuaacuucgaaagcaccgggaaucugaucgcucccgaguacggauuuaaaaucucuaagcgcggcuccagcgggauuaugaaaacagaaggaacgcuugagaacugcgagaccaagugucagacaccucugggcgccaucaauaccacacuccccuuccauaacgugcacccgcugaccauuggggaaugcccuaaauaugucaaguccgagaaacuuguucuggcgacgggacucagaaaugugccccagaucgaaucucggggccuguuuggcgccauugcuggguucaucgagggaggcuggcaagggaugguggacggaugguacggcuaucaucacagcaacgaucagggguccggcuacgccgcugacaaggaaagcacacagaaggccuuugacggaaucaccaauaaagucaacucugugauugagaagaugaauacccaguucgaggcgguuggcaaagaauuuuccaaccuggagcgcagacucgaaaaucugaacaagaaaauggaggauggguuccuugacguguggacauauaaugccgaacugcucguccugauggagaacgagcggacccuugauuuccacgacagcaaugugaagaaccuguacgauaagguucgcaugcaacucagagacaacgugaaagaacugggaaauggcuguuuugaguucuaucauaagugcgaugacgaauguaugaacucugucaaaaaugggacauacgauuacccuaaguaugaggaggaaagcaaacugaaccggaaugagaucaagggagugaagcucuccucuaugggcgucuaccagauucuggcuaucuaugccacgguggcugggagccuuucccuggccauuaugauggccggcaucagcuuuuggaugugcucuaacggaucccuccagugcagaaucuguauuuga

SEQ ID NO: 185322 - RNA, 1689 nt, Artificial Sequence
  derived and/or modified sequence opt5 from hemagglutinin__InfluenzaA__ACD85220
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccuaaguauagccugugcuaccccggguccuuuaaugauuaugaagaacuuaagcaucugcucucuagcgucaaacacuucgaaaaggugaaaauucugccuaaggaccgguggacacaacauaccacaaccggaggcuccaaagccugugccguuucuggcgagcccagcuuuuuccgcaacaugguguggcuuacgaagaaggggccuaauuacccggucgcuaaaggauccuauaacaauaccagcggcgagcagaugcugaucauuuggggagugcaccaccccaaggaugaagccgagcagagagcucucuaccagaacguugggacauacgugucugccuccaccagcacacugaauaaacggucuaccccugaaaucgcggcccgccccgaggucaacggccugggguccagaauggaauuuagcuggacgcuccuggacgugugggauacaauuaauuucgagucuaccggaaaccuuguggcuccugaguauggcuuuaagaucuccaaacggggcagcuccgggaucaugaagacagaaggaacccugggcaacugcgagaccaaaugucaaacaccccucggggccauuaauacgacccugccguuccauaacguccacccucuuacaaucggagaaugccccaaguacguuaagucugagaaacuggugcucgcuaccggccugcgcaaugugccucagauugaaagcagagggcuguuuggagccaucgcgggcuucauugagggcggguggcagggaauggucgacggcugguauggguaccaucacuccaacgaucagggaagcggcuaugccgcugacaaggagucuacacaaaaagccuuugaugggaucaccaauaaggugaacuccguuaucgagaaaaugaauacgcaguucgaggcugugggcaaggaauuuaacaaucucgagaagcggcuggaaaaccuuaauaaaaagauggaggacggauuccuggacgucuggacauacaacgccgagcuccuggugcuuauggaaaaugagcgcacccuggauuuccacgacagcaacguuaaaaaucucuaugauaaggugagaaugcagcugcgggacaacgucaaagaacugggcaacggguguuuugaguucuaccauaagugcgaugacgaguguaugaacucugugaagaauggaaccuacgauuaucccaaauacgaaaaggagagcaaacucaaucgcaacgaaauuaagggcgucaaacuguccucuauggggguguaucagauccuugccauuuacgcuacaguugcgggaagccugucccucgccaucaugauggcuggcauuagcuuuuggaugugcucuaaugggucccugcaaugcagaaucuguaucuga

SEQ ID NO: 185323 - RNA, 1689 nt, Artificial Sequence
  derived and/or modified sequence opt5 from hemagglutinin__InfluenzaA__ACD85242
auggccaucauuuaccugauccuccuguucgcuaccgugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccgggucccuuaaugauuaugaggaacugaagcaucuccugucuagcgucaagcacuuugaaaaagugcgcauucuuccuaaggacagauggacacaacauaccacaaccggaggcuccaaagccugugccguuucuggcaagcccagcuucuuucggaacaugguguggcugacgaaaaaggggccuaauuacccggucgcuaagggauccuauaacaauaccagcggcgagcagaugcucaucauuuggggagugcaccaccccaaagaugaggccgaacagcgcgcucuguaccaggagguugggacauacgugucugccuccaccagcacacugaacaagagaucuaucccugaaauugcggcccggcccgaggucaauggccucgggucccgcauggaguucagcuggacccugcuugacgugugggauacgaucaacuuugaaucuacaggaaaucugguggcuccugaguauggcuucaaaaucuccaagagaggcagcuccgggauuaugaaaaccgaaggaacacucggcaacugcgagaccaagugucaaacaccccugggggccaucaacaccacgcuuccguuucauaauguccacccucugaccauuggagaaugccccaaauacguuaagucugagaagcucgugcuggcuacaggccugcggaacgugccucagaucgaaagccgcgggcuuuucggagccauugcgggcuuuaucgagggcggguggcagggaauggucgacggcugguauggguaccaucacuccaaugaucagggaagcggcuaugccgcugacaaagagucuacccaaaaggccuucgaugggaucacaaacaaaguuaauuccaugauugaaaagaugaacacccaguuugaggcugugggcaaagaguucaauaaccuggaaaagagacuugaaaaucuggacaagaaaauggaggacggauuucucgauguguggacguacaacgccgagcugcuuguccugauggaaaaugagcggacacucgacuuccacgauagcaacgugaagaaucuguaugaaaaaguucgcaugcagcugagagacaacgugaaggagcucggcaauggguguuucgaguuuuaccauaaaugcgauaacgaauguaugaacucugucaagaauggaaccuacgacuaucccaaguacgaggaagagagcaaacugaagcggaacgaaaucaaaggcgugaagcucuccucuaugggggucuaucagauucuggccaucuacgcuaccguggcgggaagccucucccuggccauuaugguugcuggcaucagcuucuggaugugcucuaaugggucccugcaaugcagaaucuguauuuga

SEQ ID NO: 185324 - RNA, 1689 nt, Artificial Sequence
  derived and/or modified sequence opt5 from hemagglutinin__InfluenzaA__ACD85253
auggccaucauuuaccugauccuccuguucgcuaccgugagaggcgaccagauuugcaucggguaucacgccaacaauagcacagagaaggucgauacgauucuugaacggaacguuaccgugacacaugcgaaggacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauaaucugugcuaccccgggagccuuaacgaauaugaggaacugaagcaucuccuguccucugucaagcacuuugagaaagugcgcauucuuccuaaggauagauggacacaacauaccacaaccggaggcagcaaagccugugccguuuccggcgagcccucuuucuuucggaauaugguguggcugacgaagaaagggccuaacuacccggucgcuaagggaagcuauaauaacaccuccggcgaacagaugcucaucauuuggggcgugcaccaccccaaugacgaggccgaacagcgcgcucuguaccagaagguuggaacauacgugagcgccucuaccuccacacugaacaaaagaagcaucccugagauugcggcccggcccaaggucaauggccucgggucucgcauggaguucuuuuggacccugcuugaugugugggacacgaucaacuucgaauccacaggaaaccugguggucccugaguauggcuuuaaaaucagcaagagagggucuuccgggauuaugaaaaccgaaggaacacucggcaauugcgagaccaagugucaaacaccccugggggcuaucaacaccacgcuuccguuccauaauguucacccucugaccauuggagaaugccccaaauacgucaagagcgagaagcucgugcuggccacaggccugcggaacgugccucagaucgaaucccgcgggcucuuuggagcuauugccggcuucaucgagggcggguggcagggaaugguggauggcugguauggguaccaucacucuaaugaccagggaagcggcuaugcggccgauaaagaguccacccaaaaggcuuuugacgggaucacaaacaaaguuaauagcgugauugaaaagaugaacacccaguucgagacggucggcaaagaauuuaauaaccuggagaagagacuugaaaaucugaacaagaaaauggaggauggauuccucgacguguggacauacaaugccgagcugcuuguucugauggaaaacgagcggacccucgacuuccacgauucuaaugugaagaaccuguaugaaaaaguccgcaugcagcugagagacaacgugaaggagcucggcaauggguguuuugaguucuaccauaaaugcgaugacgaauguaugaacuccgucaagaauggaaccuacgauuaucccaaguacgaggaagagagcaaacugaagcggaacgaaaucaaaggcgugaaacuuucuagcauggggguuuaucagauucuggcuaucuacgccacaguggccggaucccucucucuggcuauuauggucgcgggcaucagcuuuuggaugugcuccaaugggagccugcaaugcagaaucuguauuuga

SEQ ID NO: 185325 - RNA, 1701 nt, Artificial Sequence
  derived and/or modified sequence opt5 from hemagglutinin__InfluenzaA__ACD85440
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggaucuggggaauggaugcuuuaagaucuaccacaaaugugacaacgccugcauuggcucuauccggaaugggacauaugaucaugacguuuacagagacgaggcucucaacaaucgcuuccagauuaagggcguggaacugaaauccggauacaaggauuggauccuuuggauuagcuuugccaucucuugcuuccugcucugugucgcccugcugggcuuuaucaugugggcuugccagaaagggaacauucgguguaauaucugcauuuga

SEQ ID NO: 185326 - RNA, 1701 nt, Artificial Sequence; identical to SEQ ID NO: 185325
  derived and/or modified sequence opt5 from hemagglutinin__InfluenzaA__ACD85451

SEQ ID NO: 185327 - RNA, 1701 nt, Artificial Sequence; identical to SEQ ID NO: 185325
  derived and/or modified sequence opt5 from hemagglutinin__InfluenzaA__ACD85462

SEQ ID NO: 185328 - RNA, 1701 nt, Artificial Sequence; identical to SEQ ID NO: 184952
  derived and/or modified sequence opt5 from hemagglutinin__InfluenzaA__ACD85473

SEQ ID NO: 185329 - RNA, 1701 nt, Artificial Sequence
  derived and/or modified sequence opt5 from hemagglutinin__InfluenzaA__ACD85484
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgaggaguucgacaaacuguacauuuggggcgugcaccauccugggacggauaaugaccagaucuuucucuaugcgcaggccucuggacgcauuacaguuuccaccaagagaagccaacagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacagaauacccugaaacuugccacagggaugcggaacguucccgaaaaacaaacccgcggaauuuucggcgcgaucgccggguuuaucgagaauggaugggagggcaugguggaugggugguauggauucagacaccagaacuccgaaggcauuggccaggcugccgaccugaagucuacacaagcugccaucgaucagauuaaugggaaacucaaccggcugaucggaaagaccaacgagaaauuccaccagauugaaaaggaguuuagcgaaguggagggcagaauccaggaccuugagaaguacgucgaagauacgaaaauugaccugugguccuauaaugccgagcuccugguggcucuggaaaaccaacauacaaucgaucucaccgacagcgagaugaauaagcuguucgaaaagaccaagaaacagcuucgcgagaacgcggaggauauggggaauggaugcuuuaagaucuaccacaagugugacaacgccugcauuggcucuauccggaaugggacauaugaucaugacguuuacagagacgaagcucugaacaaucgcuuccagauuaaaggcguggagcucaaguccggauacaaagauuggauccuguggauuagcuuugccaucucuugcuuccuucugugugucgcccuccugggcuuuaucaugugggcuugccagaaggggaacauucgguguaauaucugcauuuga

SEQ ID NO: 185330 - RNA, 1701 nt, Artificial Sequence; identical to SEQ ID NO: 184952
  derived and/or modified sequence opt5 from hemagglutinin__InfluenzaA__ACD85495

SEQ ID NO: 185331 - RNA, 1701 nt, Artificial Sequence
  derived and/or modified sequence opt5 from hemagglutinin__InfluenzaA__ACD85528
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacguuucucuccggagccugguggcuuccagcgggacgcuugaauuuaacaaugagucuuucaacuggaccggagucacacagaauggcaccuccagcgccugcauccgcagaucuaacaaguccuuuuucagccggcugaauuggcucacacaucugaaguuuaaauauccugcucuuaacgugaccaugcccaauaacgagaacuucgacaagcuguacauuuggggcguucaccauccugggacggauaaugaccagaucuuucucuaugcccaggcgucuggacgcauuacaguguccaccaaaagaagccaacagacagucaucccgaacauuggcucccggccccgcgugagaaauaucccuucucggaucagcauuuacuggaccaucgugaagcccggggauauucugcugaucaacuccaccggaaaucucauugccccucgcggcuacuucaaaaucagaagcgggaagucuuccaucaugcggagcgacgcucccauuggaaaguguaacucugaaugcaucacaccgaauggcagcauuccuaacgacaaacccuuucagaaugucaaccgcaucacguauggcgccuguccuagauacguuaagcagaauacccugaaacuugcuacagggaugcggaacgugcccgagaagcaaacccgcggaauuuucggcgccaucgcgggguuuaucgaaaauggaugggagggcaugguggaugggugguauggauucagacaccagaacuccgagggcauuggccaggccgcugaccugaaaucuacacaagccgcuaucgaucagauuaaugggaagcucaaccggcugaucggaaaaaccaacgaaaaguuccaccagauugagaaggaauuuagcgaggucgaaggcagaauccaggaccuugagaaauacguggaggauacgaagauugaccugugguccuauaaugccgaacuccugguugcccuggagaaccaacauacaaucgaucucaccgacagcgaaaugaauaaacuguucgagaagaccaaaaagcagcuucgcgaaaacgcugaggaucuggggaauggaugcuuuaagaucuaccacaaaugugacaacgcgugcauuggcucuauccggaaugggacauaugaucaugacguguacagagacgaggcccucaacaaucgcuuccagauuaagggcgucgaacugaaauccggauacaaggauuggauccuuuggauuagcuuugcuaucucuugcuuccugcucuguguggcccugcugggcuuuaucaugugggccugccagaaagggaacauucgguguaauaucugcauuuga

SEQ ID NO: 185332 - RNA, 1701 nt, Artificial Sequence
  derived and/or modified sequence opt5 from hemagglutinin__InfluenzaA__ACD85539
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaacaaacaauuccuuuuucucucggcugaacuggcucacccaucugaaguuuaaguauccugcccuuaaugucacgaugcccaacaacgagaaauucgacaagcuguacauuuggggcgugcaccauccugggacagauaaugaccagaucuuucucuaugcgcaggccagcggacgcauuaccguuucuacaaaaagaucccaacagaccgugaucccgaacauuggcagccggccccgcgucagaaauaucccuucccggaucucuauuuacuggaccaucgugaagcccggggauauucugcugaucaacagcacaggaaaucucauugcuccucgcggcuacuucaaaaucagauccgggaaaagcucuaucaugcgguccgacgcccccauuggaaaguguaacagcgaaugcaucacgccgaauggcucuauuccuaacgacaaacccuuucagaaugugaaccgcaucaccuauggcgcuuguccuagauacgucaagcagaauacacugaaacuugccaccgggaugcggaacguucccgagaagcaaacacgcggaauuuucggcgcgaucgccggguuuaucgaaaauggaugggagggcaugguggaugggugguauggauucagacaccagaacagcgagggcauuggccaggcugccgaccugaaauccacccaagcugccaucgaucagauuaaugggaagcucaaccggcugaucggaaaaacgaacgaaaaguuccaccagauugagaaggaauuuucugagguggaaggcagaauccaggaccuugagaaauacgucgaggauacaaagauugaccuguggagcuauaaugccgaacuccugguggcucuggagaaccaacauaccaucgaucucaccgacuccgaaaugaauaaacuguucgagaagacaaagaagcagcuucgcgaaaacgcggaggauauggggaauggaugcuuuaagaucuaccacaaaugugacaacgccugcauuggcagcauccggaaugggaccuaugaucaugacguuuacagagacgaggcucugaacaaucgcuuccagauuaagggcguggaacucaaaucuggauacaaggauuggauccuguggauuuccuuugccaucagcugcuuccuucugugugucgcccuccugggcuuuaucaugugggcuugccagaaagggaacauucgguguaauaucugcauuuga

SEQ ID NO: 185333 - RNA, 1701 nt, Artificial Sequence
  derived and/or modified sequence opt5 from hemagglutinin__InfluenzaA__ACD85550
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggaucuggggaauggaugcuuuaagaucuaccacaaaugugacaacgccugcauuggcucuauccggaaugggacauaugaucaugacguuuacagagacgaggcucucaacaaucgcuuccagauuaagggcguggaacugaaauccggauacaaggauuggauccuuuggauuagcuuugccaugucuugcuuccugcucugugucgcccugcugggcuuuaucaugugggcuugccagaaagggaacauccgguguaauauuugcaucuga

SEQ ID NO: 185334 - RNA, 1701 nt, Artificial Sequence; identical to SEQ ID NO: 184952
  derived and/or modified sequence opt5 from hemagglutinin__InfluenzaA__ACD85561

SEQ ID NO: 185335 - RNA, 1701 nt, Artificial Sequence
  derived and/or modified sequence opt5 from hemagglutinin__InfluenzaA__ACD85572
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacaccggcucccggccccgcgucagaaauauuccuucucggaucagcaucuacuggaccauugugaagcccggggauauccugcugauuaacuccacaggaaaucucaucgcuccucgcggcuacuucaaaauuagaagcgggaagucuuccaucaugcggagcgacgcccccaucggaaaguguaacucugaaugcauuacgccgaauggcagcaucccuaacgacaaacccuuucagaaugugaaccgcauuaccuauggcgcuuguccuagauacgucaagcagaauacacugaaacuugccaccgggaugcggaacguucccgagaagcaaacacgcggaaucuucggcgcgauugccggguuuaucgaaaauggaugggagggcaugguggaugggugguauggauucagacaccagaacuccgagggcaucggccaggcugccgaccugaaaucuacccaagcugccauugaucagaucaaugggaagcucaaccggcugauuggaaaaacgaacgaaaaguuccaccagaucgagaaggaauuuagcgagguggaaggccgcauucaggaccuugagaaauacgucgaggauacaaagaucgaccugugguccuauaaugccgaacuccugguggcucuggagaaccaacauaccauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcguggaacucaaauccggauacaaggauuggauucuguggaucagcuuugccauuucuugcuuccuucugugugucgcccuccugggcuuuaucaugugggcuugccagaaagggaacauccgguguaauauuugcaucuga

SEQ ID NO: 185336 - RNA, 1701 nt, Artificial Sequence; identical to SEQ ID NO: 185332
  derived and/or modified sequence opt5 from hemagglutinin__InfluenzaA__ACD85583

SEQ ID NO: 185337 - RNA, 1701 nt, Artificial Sequence
  derived and/or modified sequence opt5 from hemagglutinin__InfluenzaA__ACD93579
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacacaugcauuggcucuauccggaaugggaccuaugaucaugacguuuacagagacgaggcccugaacaaucgcuuccagauuaagggcguggaacucaaauccggauacaaggauuggauccuguggauuagcuuugcuaucucuugcuuccuucugugugucgcccuccugggcuuuaucaugugggccugccagaaagggaacauucgguguaauaucugcauuuga

SEQ ID NO: 185338 - RNA, 1701 nt, Artificial Sequence; identical to SEQ ID NO: 183654
  derived and/or modified sequence opt5 from hemagglutinin__InfluenzaA__ACF09402

SEQ ID NO: 185339 - RNA, 1701 nt, Artificial Sequence
  derived and/or modified sequence opt5 from hemagglutinin__InfluenzaA__ACF22159
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcaaaauucuagcacaggcgggaucugcgacuccccgcaccagauccuugauggagagaacuguacccugauugacgcccuccugggcgauccccagugcgacggguuucagaauaaaaagugggaucuguucgucgaaagaucuaaagccuauagcaacuguuacccuuaugacgugcccgauuacgcuucccuccggucucugguugccagcuccggaacgcuugaguuuaauaacgaaucuuucaauuggaccggcgugacacagaacggcaccucuuccgcuugcaagcgcagaagcaauaagagcuuuuucucccggcugaacuggcucacacaucugaaauauaaguacccugcccuuaaugucaccaugcccaacaacgagaaauuugacaagcuguauaucuggggagugcaccauccugggacggauagcgaccagauuucucucuacgcgcaggccuccggccgcaucacaguuagcaccaaaagaucccaacagacagugauuccgaauaucggguuccggccccgcgucagagaugugucuagccggauuuccaucuacuggaccaucgugaagccuggagacauucugcugaucaacagcaccggcaaucucauugcuccccgcggguauuuuaagaucagaucuggaaaauccagcauuaugcggucugacgccccuaucggcaaguguaacagcgagugcaucacacccaauggcuccauuccgaacgauaaaccuuuccagaaugucaaccgcaucacguacggggcuugucccagauauguuaagcagaauacccugaaacuugccacaggaaugcggaacgugccugaaaagcaaacccgcggcauuuuuggggcgaucgccggauucauugagaauggcugggaagggaugguggacggaugguacggcuuuagacaccagaacucugagggcacagggcaggcugccgaucugaaaagcacccaagcugccaucaaucagaucaacggaaagcucaaucggcugauuggcaagacgaacgagaaauuccaccagaucgaaaaggaguucuccgaagucgaggggcgcauucaggaccuugaaaaauauguggaggauacaaagaucgaccuguggagcuacaacgccgagcuccugguugcucuggaaaaucaacauaccauugaucucaccgacucugagaugaacaaacuguuugaaagaacaaagaagcagcuucgggagaaugcggaagauaugggaaacggcugcuucaaaaucuaucacaagugugacaaugccugcauugaguccaucagaaacgggaccuacgaucaugacguguaccgcgacgaggcucugaauaaccgguuucagaucaaaggcgucgaacucaagagcggauauaaagauuggauucuguggaucucuuucgccauuuccugcuuucuucuguguguggcccuccugggcuucaucaugugggcuugccagaaggggaauauuagauguaacaucugcaucuga

SEQ ID NO: 185340 - RNA, 1701 nt, Artificial Sequence
  derived and/or modified sequence opt5 from hemagglutinin__InfluenzaA__ACF22188
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucuggucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugagugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgaaaagcagaccagaggccuguuuggggcuaucgccggauucauugagaauggcugggaaggcaugaucgaugggugguacggauuucggcaccaaaacuccgagggcaccgggcaggcggccgaccucaagucuacacaggcugccauugaucaaaucaauggaaaacugaaccgcguuaucgagaagaccaaugaaaaauuccaccagauugagaaggaguucagcgaaguggaaggcagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauauggggaauggcugcuucaagauuuaucacaaaugugacaacgcuugcaucgagucuauucggaauggaaacuacgaccaugauguuuauagagacgaagcgcugaauaaccgcuuucagaucaagggcguggagcucaaauccggguacaaggauuggauccuguggauuagcuucgccaucucuugcuuucuucugugugucgugcuccugggauucauuaugugggcuugccagcggggcaauaucagauguaacauuugcaucuga

SEQ ID NO: 185341 - RNA, 1701 nt, Artificial Sequence; identical to SEQ ID NO: 185340
  derived and/or modified sequence opt5 from hemagglutinin__InfluenzaA__ACF22199

SEQ ID NO: 185342 - RNA, 1701 nt, Artificial Sequence
  derived and/or modified sequence opt5 from hemagglutinin__InfluenzaA__ACF22210
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauaugggcaauggaugcuucaagauuuaucacaaaugugacaacgcuugcaucgagucuauucggaauggcaccuacgaccaugauguuuauagagacgaagcgcugaacaaucgcuuucagaucaaggggguggagcucaaauccggauacaaggauuggauccuguggauuagcuucgccaucucuugcuuucuucugugugucgugcuccugggcuucauuaugugggcuugccagcgggggaacaucagauguaauauuugcaucuga

SEQ ID NO: 185343 - RNA, 1701 nt, Artificial Sequence; identical to SEQ ID NO: 185342
  derived and/or modified sequence opt5 from hemagglutinin__InfluenzaA__ACF22221

SEQ ID NO: 185344 - RNA, 1701 nt, Artificial Sequence; identical to SEQ ID NO: 185342
  derived and/or modified sequence opt5 from hemagglutinin__InfluenzaA__ACF22232

SEQ ID NO: 185345 - RNA, 1701 nt, Artificial Sequence; identical to SEQ ID NO: 185342
  derived and/or modified sequence opt5 from hemagglutinin__InfluenzaA__ACF22243

SEQ ID NO: 185346 - RNA, 1701 nt, Artificial Sequence; identical to SEQ ID NO: 185342
  derived and/or modified sequence opt5 from hemagglutinin__InfluenzaA__ACF22254

SEQ ID NO: 185347 - RNA, 1701 nt, Artificial Sequence; identical to SEQ ID NO: 185342
  derived and/or modified sequence opt5 from hemagglutinin__InfluenzaA__ACF22265

SEQ ID NO: 185348 - RNA, 1701 nt, Artificial Sequence; identical to SEQ ID NO: 185342
  derived and/or modified sequence opt5 from hemagglutinin__InfluenzaA__ACF22276

SEQ ID NO: 185349 - RNA, 1701 nt, Artificial Sequence; identical to SEQ ID NO: 185342
  derived and/or modified sequence opt5 from hemagglutinin__InfluenzaA__ACF22287

SEQ ID NO: 185350 - RNA, 1701 nt, Artificial Sequence; identical to SEQ ID NO: 185342
  derived and/or modified sequence opt5 from hemagglutinin__InfluenzaA__ACF22298

SEQ ID NO: 185351 - RNA, 1701 nt, Artificial Sequence; identical to SEQ ID NO: 185342
  derived and/or modified sequence opt5 from hemagglutinin__InfluenzaA__ACF22320

SEQ ID NO: 185352 - RNA, 1701 nt, Artificial Sequence; identical to SEQ ID NO: 185342
  derived and/or modified sequence opt5 from hemagglutinin__InfluenzaA__ACF22342

SEQ ID NO: 185353 - RNA, 1701 nt, Artificial Sequence
  derived and/or modified sequence opt5 from hemagglutinin__InfluenzaA__ACF22364
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugaaugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgagaaacagaccagaggccuguuuggggcuaucgccggauucauugaaaauggcugggagggcaugaucgaugggugguacggauuucggcaccaaaacuccgagggcaccgggcaggcggccgaccucaagucuacacaggcugccauugaucaaaucaauggaaaacugaaccgcguuaucgaaaagaccaaugagaaauuccaccagauugaaaaggaguucagcgaaguggagggcagaauccaggaccuugagaaauaugucgaagauacaaagauugaccugugguccuacaacgcugagcuccugguggcccuggaaaaucagcauacgaucgaucucaccgacagcgagaugaacaagcuguuugaaaagacacggagacaacuucgcgagaacgccgaggauauggggaauggcugcuucaagauuuaucacaaaugugacaacgcuugcaucgaaucuauucggaauggaaccuacgaccaugauguuuauagagacgaggcgcugaacaaucgcuuucagaucaagggcguggaacucaaauccggguacaaggauuggauccuguggauuagcuucgccaucucuugcuuucuucugugugucgugcuccugggauucauuaugugggcuugccagcggggcaacaucagauguaauauuugcaucuga

SEQ ID NO: 185354 - RNA, 1701 nt, Artificial Sequence; identical to SEQ ID NO: 185332
  derived and/or modified sequence opt5 from hemagglutinin__InfluenzaA__ACF22408

SEQ ID NO: 185355 - RNA, 1701 nt, Artificial Sequence; identical to SEQ ID NO: 184952
  derived and/or modified sequence opt5 from hemagglutinin__InfluenzaA__ACF41669

SEQ ID NO: 185356 - RNA, 1698 nt, Artificial Sequence; identical to SEQ ID NO: 184938
  derived and/or modified sequence opt5 from hemagglutinin__InfluenzaA__ACF41680

SEQ ID NO: 185357 - RNA, 1689 nt, Artificial Sequence
  derived and/or modified sequence opt5 from hemagglutinin__InfluenzaA__ACF41691
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccggguccuuuaaugauuaugaagaacuuaagcaucugcucucuagcgucaagcacuucgaaaaagugaagauucugccuaaagacggauggacacaacaugagaccgauggcggcuccaaggccugugccguuucugggaaacccagcuuuuuccgcaacaugguguggcuuacaaagaagggaccuaauuacccggucgcuaaaagauccuauaacaauaccagcggcgagcagaugcugaucauuuggggagugcaccaccccaacgacgaagccgagcagcgggcucucuaccaggaaguugggacguacgugucugccuccaccagcacacugaauaagcgcucuaccccugagaucgcggccagacccaaagucuccggccuggggagccggauggaauuuucuuggacacuccuggaugugugggacaccauuuccuucgagagcacgggaaaccuuguggcuccugaguauggcuuuaagaucuccaaacgcggcucuagcgggaucaugaagacagaaggaacccugggcaauugcgagacaaaaugucaaacaccccucggggccauuaacaccacccugccguuccauaacguccacccucuuacgaucggagaaugccccaaguacguuaaguccgagaaacuggugcucgcuaccggccugagaaaugugccucagauugaaagccgggggcuguuuggagccaucgcgggcuucauugagggcggguggcagggaauggucgauggcugguauggguaccaucacucuaacgaccagggauccggcuaugccgcugauaaggagagcacacaaaaagccuuugaccgcaucaccaauaaggugaacucuguuaucgagaaaaugaauacacaguucgaggcuguggggaaggaauuuagcaaccucgagaagagacuggaaaaucuuaacaaaaagauggaggacggcuuccuggaugucuggaccuacaaugccgagcuccuggugcuuauggaaaacgagcggacgcuggacuuccacgauuccaauguuaaaaaccucuaugacaaggugcgcaugcagcugagagauaaugucaaagaacugggaaacggcuguuuugaguucuaccauaagugcgacgaugaguguaugaacucugugaagaaugggacauacgacuaucccaaauacgaagaggaaagcaagcucaaacggaacgagauuaagggagucgaacuguccagcaugggcguguaucagauccuugccauuuacgcuaccguugcggggucucugucccucgccaucaugauugcuggaaucagcuuuuggaugugcucuaauggcucccugcaaugcagaaucuguauuuga

SEQ ID NO: 185358 - RNA, 1701 nt, Artificial Sequence; identical to SEQ ID NO: 185340
  derived and/or modified sequence opt5 from hemagglutinin__InfluenzaA__ACF41735

SEQ ID NO: 185359 - RNA, 1701 nt, Artificial Sequence
  derived and/or modified sequence opt5 from hemagglutinin__InfluenzaA__ACF41790
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaagacuuuaccuggacaggagugacccagaacggcggcagcaaugcuugcaagagagggccuggaucuggcuucuuuucccggcucaacuggcugacgaaaagcgggucuacauaccccguccuugaugugaccaugccuaauaacgacaauuucgacaagcuguauauuuggggaguucaccauccguccacaaaccaagagcagaccagccucuacgugcaggccucuggccgcgucaccguguccacaagacggagccagcaaacgaucauucccaauaucgggucccgcccuugggugagaggacugucuagccggauuuccaucuauuggaccaucgucaagcccggcgauguucuggugauuaacagcaacggcaaucucaucgcgccucgcggguacuuuaaaaugagaacaggaaagucuuccauuaugcggagcgacgcccccaucgauaccuguauuucugagugcaucacaccgaacggcagcaucccuaaugacaaacccuuccagaacgugaauaagauuaccuacggggcuuguccuaaauaugucaagcagaacacgcugaaacuugccacaggaaugcgcaaugugcccgaaaagcagaccagaggccuguuuggggcuaucgccggauucauugagaacggcugggaaggcaugaucgaugggugguacggauuucggcaccaaaauuccgagggcaccgggcaggcggccgaccucaagucuacacaggcugccauugaucaaaucaacggaaaacugaaucgcguuaucgagaagaccaacgaaaaauuccaccagauugagaaggaguucagcgaaguggaaggcagaauccaggaccuugagaaauaugucgaggauacaaagauugaccugugguccuacaaugcugaacuccugguggcccuggagaaccagcauacgaucgaucucaccgacagcgaaaugaauaagcuguuugagaaaacacggagacaacuucgcgaaaacgccgaggacauggggaacggcugcuucaagauuuaucacaaaugugauaaugcuugcaucgagucuauucggaacggaaccuacgaccaugauguuuauagagacgaagcgcugaauaaccgcuuucagaucaagggcguggagcucaaauccggguacaaggauuggauccuguggauuagcuucgccaucucuugcuuucuucugugugucgugcuccugggauucauuaugugggcuugccagcggggcaauaucagauguaacauuugcaucuga

SEQ ID NO: 185360 - RNA, 1701 nt, Artificial Sequence
  derived and/or modified sequence opt5 from hemagglutinin__InfluenzaA__ACF41823
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccgccagacgaucauucccaacaucggauccagaccuugggugcggggccugucuagccgcauuuccaucuauuggaccaucgucaagcccggcgacguucuggugauuaacagcaaugggaaccucaucgcgccuagaggauacuuuaaaaugcggacaggcaagucuuccauuaugcgcagcgacgcccccaucgauaccuguauuucugagugcaucacaccgaaugggagcaucccuaacgacaaacccuuccaaaaugugaacaagauuaccuacggagcuuguccuaaauaugucaagcagaauacgcugaaacuugccacaggcaugagaaacgugcccgaaaagcagacccgggggcuguuuggagcuaucgccggcuucauugagaauggcugggaagggaugaucgauggaugguacggcuuucgccaccagaacuccgaggggaccggacaagcggccgaccucaagucuacacaggcugccauugaucagaucaauggcaaacugaacagaguuaucgagaagaccaaugaaaaauuccaccaaauugagaaggaguucagcgaaguggaagggcggauccaggaccuugagaaauaugucgaggauacaaagauugaccugugguccuacaacgcugaacuccugguggcccuggagaaucagcauacgaucgaucucaccgacagcgaaaugaacaagcuguuugagaaaacaagacgccagcuucgggaaaacgccgaggauaugggcaauggaugcuucaagauuuaucacaaaugugacaacgcuugcaucgagucuauuagaaauggcaccuacgaccauaacguuuaucgcgaugaagcgcugaauaaccgguuucaaaucaaggggguggagcucaaauccggauacaaggacuggauccuguggauuagcuucgccaucucuugcuuucuucugugugucgugcuccugggcuucauuaugugggcuugccagagagggaauauccgcuguaacauuugcaucuga

SEQ ID NO: 185361 - RNA, 1698 nt, Artificial Sequence
  derived and/or modified sequence opt5 from hemagglutinin__InfluenzaA__ACF41834
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaggaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaccugaaaaauuccuacgugaacaagaaagggaaggagguucuggugcucuggggcauucaucacccgagcaacucuaaagaacagcagaaucuguaucagaacgagaaugcguacgucuccguggugacgagcaacuacaaucgcagauuuacccccgaaaucgccgagcggccuaagguccgcgaccaagcuggaagaaugaacuauuacuggacacuucugaagcccggggauaccauuaucuucgaggccaauggaaaccucauugcuccuauguaugccuuugcgcugucccggggcuucgggucuggaaucauuacaagcaaugccuccaugcacgaauguaacaccaaaugccagacgccccuuggcgcuaucaauagcucucugccguaccagaacauccauccuguuacaauuggcgagugucccaaguaugugcgcuccgccaaacucagaauggugaccgggcugcggaauaucccuagcauucagucucgcggacuguuuggcgcuaucgccggguucauugaaggaggcuggacagggaugaucgacggaugguacggcuaucaccaucaaaacgagcagggcagcggguacgccgcugaucagaaguccacccagaaugcgaucaacggaauuaccaacaaagucaauacagugaucgaaaagaugaacauucaauuuacggccguuggcaaagaguucaauaagcucgagaagagaauggaaaaccugaauaaaaagguggacgauggguuucuugacaucuggaccuacaacgcugagcugcucguccugcuugaaaaugagcggacacuggacuuccacgauucuaacgugaaaaaucucuaugaaaagguuaaaagccagcugaagaacaaugccaaggagauuggaaacggcugcuucgaguuuuaccacaaaugugacaaugaaugcauggaguccgugcgcaacgggaccuaugauuaccccaaguauagcgaagagucuaaacugaauagagagaaggucgacggcgugaaacucgaauccaugggaaucuaccagauccuggccauuuauagcacagucgcuucuucccuugugcugcucguuagccugggcgccaucuccuucuggaugugcucuaacgggagccugcaaugucggauuugcaucuga

SEQ ID NO: 185362 - RNA, 1701 nt, Artificial Sequence
  derived and/or modified sequence opt5 from hemagglutinin__InfluenzaA__ACF41856
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucaggauggcggcucuuaugccugcaagcggggguccgucaacagcuuuuucucucgccucaauuggcugcacaaguccgaguacaaauauccugcgcuuaacgugacaaugcccaauaacggaaaguuugacaaacuguacaucuggggcguucaucacccuagcaccgauagagaccaaacaucucucuacgugcgggccuccgggcgcgucaccgugagcacgaagagaucccagcagacagugaccccgaauauuggaucucggcccuggguccgcggccagagcuccagaaucagcauuuauuggacaaucguuaaaccuggggacauucugcugaucaacucuaccggaaaccucaucgcuccccggggcuacuucaagauucgcaauggcaaguccagcaucaugagaucugaugccccuauugggaccuguagcuccgagugcaucacacccaacggaucuauuccgaaugacaaaccuuuucaaaacgugaaucggaucacguauggcgcuuguccccgcuacgugaagcagaacacccugaaacuugccacagggaugagaaaugucccugaaaagcagacccggggaaucuucggcgcgauugccggguuuaucgagaacggaugggaaggcaugguggauggcugguauggguucagacaccagaauagcgagggaacaggccaagcugccgaccugaaauccacccaggcugccauugaucagaucaacgggaagcucaaucgccugauugagaaaacgaacgaaaaguuucaucaaaucgagaaggaguucagcgaaguugaaggacggauccaggaccuugagaaauacguggaggauacaaagauugaccuguggucuuauaaugccgaacuccuggucgcucuggagaaccagcacaccaucgaucucaccgacuccgaaaugaauaaacuguucgagaagacaagaaaacagcuucgcgaaaacgcggaggauaugggcaacgggugcuuuaagauuuaccauaagugugacaaugccugcaucggcagcauucggaacggaaccuacgaccacgauguguauagagacgaggcucugaauaaccgcuuccaaaucaaaggcguugaacucaagucuggguacaaagauuggauucuguggaucuccuuugccaucagcugcuuccuucugugugugguccuccugggauuuauuaugugggccugccagaagggcaauauccgguguaacauuugcaucuga

SEQ ID NO: 185363 - RNA, 1698 nt, Artificial Sequence
  derived and/or modified sequence opt5 from hemagglutinin__InfluenzaA__ACF41867
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugaccgcuagcugcucucacaacggcaaguccagcuuuuaccgcaaucuccuguggcuuacagagaaaaacggccuguaucccaaucucucuaacuccuacguuaauaacaaggaaaaagaagugcugguccuguggggagugcaucacccuagcaacaucagagaucagcgggccauuuaccacaccgagaaugcuuauguguccgucguuucuagccauuacucccgcagauucacgccggaaaucgccaagcggcccaaagugcgcgggcaggagggcagaauuaacuauuacuggacacuccuggagccuggggacaccaucauuuuugaagcgaauggaaaccuuaucgcccccugguaugcuuucgcccugagccggggcuuugggucuggaauuaucacauccaaugcuccuaugaacgagugugaugccaagugccagacaccccaaggcgcgaucaauagcucucucccguuccagaacgugcacccugucaccauuggcgaaugucccaaguacgugcgcagcaccaaacugagaaugguuacggggcuucggaauaucccuuccauucagucucgcggacuguuuggcgccaucgcuggguucauugagggaggcuggaccgggaugauggacggaugguauggcuaccaucaccagaacgaacaaggcagcggguacgccgcugaucagaaguccacacagaaugccaucaacggaaucaccaauaaagugaacagcgucauugagaagaugaauacacaguuuaccgccgugggcaaagaguucaacaagcucgaaagacggauggagaaccugaauaaaaagguugacgauggguuccuggacaucuggacguauaacgcugaacuccuggugcuucuggagaaugaacgcacacucgauuuucacgacucuaacgucaagaaucuguacgagaaagugaagucccaacuuaaaaacaaugcgaaggagauuggaaacggcugcuucgaauuuuaucauaaauguaauaacgagugcauggaaagcgucaagaaugggaccuacgacuaucccaaguacucugaggaguccaaacugaacagagaaaagaucgauggcgugaaacucgagagcaugggaguuuaucagauucuggccaucuacuccaccguggcuucuagccugguccuccuggugucccuuggcgccaucucuuucuggaugugcagcaaugggucccugcagugucggauuugcaucuga

SEQ ID NO: 185364 - RNA, 1698 nt, Artificial Sequence; identical to SEQ ID NO: 185139
  derived and/or modified sequence opt5 from hemagglutinin__InfluenzaA__ACF41878

SEQ ID NO: 185365 - RNA, 1701 nt, Artificial Sequence
  derived and/or modified sequence opt5 from hemagglutinin__InfluenzaA__ACF41922
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaaucgcuccccuccagcugggcaauuguagcguggccggguggauucugggaaacccuaaaugcgagucccucuuuucuaaggaaagcugguccuacaucgccgagacaccgaaucccgaaaacggcaccuguuauccuggguacuucgccgacuaugaggagcugcgggaacaacuuucuagcguuuccagcuuugagcgcuucgaaauuuuucccaaggagucuuccuggccuaaucauacggugaccaaaggagucacagcuagcugcucucacaacggcaaguccagcuucuacagaaaucugcucuggcugaccgagaaaaacggccuuuaucccaaucugucuaaguccuacgugaacaauaaagaaaaggagguucucgugcuguggggaguccaucacccuagcaacauccgggaucagcgcgccaucuaccacacagaaaacgcguauguguccguggucucuagccauuacuccagacgguuuaccccggagauugccaagcgccccaaaguuagagaccaggaagggcggaucaauuauuacuggacgcugcucgagccuggcgauacaauuaucuucgaggcuaacgggaaucugauugcccccugguaugcuuuugcccuuagccgcggauucggcucugggaucauuaccuccaacgcgagcauggacgaaugugaugccaagugccagacaccucaaggagcuaucaauucuagccugcccuuucagaacgugcacccggugaccaucggcgaguguccuaaauacgucagauccaccaagcuccggauggugacaggccugcgcaauauucccucuauccagagcagagggcuuuucggagccauugcuggcuuuaucgaagggggauggacgggcaugauugacgggugguauggauaccaucaccagaacgagcaaggcuccggcuacgccgccgaucagaaaagcacccagaaugcuaucaacgggaucacaaauaagguuaacucugugauugaaaagaugaauacccaguucacagcggucggaaaggaguucaacaagcuggagcggcgcauggaaaaucucaacaaaaagguggacgauggcuuucuggacaucuggaccuauaacgccgagcugcucguucugcuugaaaaugggagaacgcuggacuuccacgauuccaacgugaaaaaucucuacgagaaggucaaaagccaacugaagaacaaugcuaaggaaauuggaaacggcugcuuugaguucuaucauaaauguaauaacgagugcauggaaucugugaagaaugggacauacgacuauccuaaauacuccgaggaaagcaaacuuaaccggggcaaaaucgauggagucaagcuggaguccaugggcguguaucagauucucgccaucuacucuaccguugccagcucccuggugcugcucgucucucugggggcuaucagcuuuuggaugugcuccaauggaagccuucaguguagaauuugcaucuga

SEQ ID NO: 185366 - RNA, 1689 nt, Artificial Sequence
  derived and/or modified sequence opt5 from hemagglutinin__InfluenzaA__ACF54389
auggccaucauuuaccugauccuccuguucgcuaccgugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccucgguauagccugugcuaccccgggucccuuaaugauuaugaagaacugaagcaucuccugucuagcgucaagcacuuugaaaaagugcgcauucuuccuaaggacagauggacacaacauaccacaaccggaggcuccaaagccugugccguuucuggcaagcccagcuucuuucggaacaugguguggcugacgaaaaaggggaccaauuacccugucgcuaagggauccuauaacaauacaagcggcgagcagaugcucaucauuuggggagugcaccacccgaucgaugaggccgaacagcgcgcucuguaccaggagguugggaccuacgugucugccuccacaagcacccugaacaaaagaucuauucccgaaaucgcggcccggccugaggucaauggccucgggucccgcauggaguucagcuggacgcugcuugacgugugggauacaaucaacuuugagucuaccggaaaucugguggcucccgaguauggcuucaagauuuccaaaagaggcagcuccgggaucaugaagacagaaggaacccucggcaacugcgagaccaaaugucaaacaccucugggggccauuaacacgacccuucccuuucauaauguccacccgcugacaaucggagaaugcccuaaguacguuaaaucugagaagcucgugcuggcuaccggccugcggaacgugccccagauugaaagccgcggacucuucggggccaucgcgggcuuuaucgagggcggguggcagggaauggucgacggcugguauggguaccaucacuccaaugagcagggaagcggcuaugccgcugauaaggaaucuacacaaaaagccuucgacgggauuaccaacaagguuaauuccgugaucgagaaaaugaacacgcaguuugaagcugugggcaaggaguucaauaaccuggagaaaagacuugaaaaucugaacaagaagauggaggauggauuucucgacgucuggacauacaaugccgaacugcuugugcugauggagaacgaacggacccucgacuuccacgauagcaauguuaaaaaccuguaugagaaggugcgcaugcagcugagagacaaugucaaagagcucggcaacggguguuucgaauuuuaccauaagugcgaugacgaguguaugaacucugugaaaaauggaaccuacgauuauccuaaguacgaagaggaaagcaagcugaaacggaacgagauuaagggcgucaaacuuuccucuauggggguguaucagauccuggccauuuacgcuacaguugcgggaagccucucccuggccaucaugguggcuggcaucagcuucuggaugugcucuaaugggucccugcaaugcagaauuuguaucuga

SEQ ID NO: 185367 - RNA, 1701 nt, Artificial Sequence; identical to SEQ ID NO: 185340
  derived and/or modified sequence opt5 from hemagglutinin__InfluenzaA__ACF54400

SEQ ID NO: 185368 - RNA, 1701 nt, Artificial Sequence; identical to SEQ ID NO: 185342
  derived and/or modified sequence opt5 from hemagglutinin__InfluenzaA__ACF54411

SEQ ID NO: 185369 - RNA, 1701 nt, Artificial Sequence; identical to SEQ ID NO: 185342
  derived and/or modified sequence opt5 from hemagglutinin__InfluenzaA__ACF54422

SEQ ID NO: 185370 - RNA, 1701 nt, Artificial Sequence; identical to SEQ ID NO: 185353
  derived and/or modified sequence opt5 from hemagglutinin__InfluenzaA__ACF54433

SEQ ID NO: 185371 - RNA, 1701 nt, Artificial Sequence; identical to SEQ ID NO: 185342
  derived and/or modified sequence opt5 from hemagglutinin__InfluenzaA__ACF54444

SEQ ID NO: 185372 - RNA, 1701 nt, Artificial Sequence; identical to SEQ ID NO: 185360
  derived and/or modified sequence opt5 from hemagglutinin__InfluenzaA__ACF54466

SEQ ID NO: 185373 - RNA, 1689 nt, Artificial Sequence
  derived and/or modified sequence opt5 from hemagglutinin__InfluenzaA__ACF54477
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggagcuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccaacuauccugucgcuaagggcagcuacaauaacaccucuggggagcagaugcugaucauuuggggagugcaccacccgaaugacgagacagaacagcggacccucuaucagaacguuggcacauacguguccgucgggaccagcacgcugaauaagcgcucuacacccgauaucgccaccagaccuaaagugaacggacugggcucccggauggaguuuagcuggacacuccuggacaugugggauaccauuaacuucgaaucuaccggcaaucuuaucgcucccgaguacggguuuaagaucuccaaacgcggaagcuccggcauuaugaagacagaagggacgcuggagaacugcgagaccaaaugucaaacaccucucggagccaucaauaccacacugcccuuccauaacgugcacccgcuuaccauuggcgaaugcccuaaguaugucaaaucugagaagcugguucucgcgacggggcugagaaaugugccccagaucgaaagccggggacuguuuggcgccauugcuggcuucaucgaagggggauggcagggcaugguggacgggugguacggauaucaucacuccaacgaucagggcagcggguacgccgcugacaaggaaucuacacaaaaagccuuugacggcaucaccaauaaggucaacuccgugauugagaaaaugaauacccaguucgaggcgguuggaaaggaauuuagcaaccucgagcgcagacuggaaaaucuuaacaaaaagauggaggauggcuuccuggacguguggacauauaaugccgaacuccugguccuuauggagaacgagcggacccuggauuuccacgacucuaaugugaagaaccucuacgauaaaguucgcaugcagcugagagacaacgugaaggaacuggggaauggauguuuugaguucuaucauaaaugcgaugacgaauguaugaacagcgucaagaauggcacauacgauuacccuaaauaugaggaggaauccaagcucaaccggaaugagaucaagggggugaaacugucuagcaugggagucuaccagauucuugcuaucuaugccacgguggcuggcucccugagccucgccauuaugauggccgggaucucuuuuuggaugugcuccaacggcagccugcaaugcagaaucuguauuuga

SEQ ID NO: 185374 - RNA, 1689 nt, Artificial Sequence
  derived and/or modified sequence opt5 from hemagglutinin__InfluenzaA__ACF54499
auggccaucauuuaccugauccuccuguucaccgcugugagaggcgaccagauuugcaucggguaucacgccaacaauagcacagagacggucgauaccauucuugaacggaacguuacagugacccaugcgaaggacauccuggagaaaacacacaauggaaagcucuguaaacugaacggcauucccccucuugaacugggggauugcuccaucgcuggauggcuccugggcaauccggagugugaccgccugcucucugugcccgaauggagcuacaucauggagaaggagaacccuagagaugggcugugcuaucccggauccuuuaaugacuacgaggagcuuaaacaucugcucucuagcgucaagcacuucgaaaaggugaaaauucugccuaaggaucgguggacccaacauacaaccacgggcggcucccgcgccugugccguuucugggaaccccagcuuuuucagaaauaugguguggcuuaccaaaaagggauccaacuauccugucgcuaaaggcagcuacaauaacacaucuggggagcagaugcugaucauuuggggagugcaccacccgaaugacgagaccgaacagcggacacucuaucagaacguuggcaccuacguguccgucgggacgagcacacugaauaagcgcucuacccccgauaucgccacaagaccuaaggugaacggacugggcucccggauggaguuuagcuggacccuccuggacaugugggauaccauuaacuucgaaucuacaggcaaucuuaucgcucccgaguacggguuuaaaaucuccaagcgcggaagcuccggcauuaugaaaacggaagggacccuggagaacugcgagacaaagugucaaaccccucucggagccaucaauacaacccugcccuuccauaacgugcacccgcuuacgauuggcgaaugcccuaaauaugucaagucugagaaacugguucucgcgacagggcugagaaaugugccccagaucgaaagccggggacuguuuggcgccauugcuggcuucaucgaagggggauggcagggcaugguggacgggugguacggauaucaucacuccaacgaucagggcagcggguacgccgcugacaaggaaucuacccaaaaggccuuugacggcaucaccaauaaagucaacuccgugauugagaagaugaauacacaguucgaggcgguuggaaaagaauuuagcaaccucgagcgcagacuggaaaaucuuaacaagaaaauggaggauggcuuccuggacguguggaccuauaaugccgaacuccugguccuuauggagaacgagcggacacuggauuuccacgacucuaaugugaagaaccucuacgauaagguucgcaugcagcugagagacaacgugaaagaacuggggaauggauguuuugaguucuaucauaagugcgaugacgaauguaugaacagcgucaaaaauggcacguacgauuacccuaaguaugaggaggaauccaaacucaaccggaaugagaucaagggggugaagcugucuagcaugggagucuaccagauucuugcuaucuaugccaccguggcuggcucccugagccucgccauuaugauggccgggaucucuuuuuggaugugcuccaacggcagccugcaaugcagaaucuguauuuga

SEQ ID NO: 185375 - RNA, 1689 nt, Artificial Sequence; identical to SEQ ID NO: 185374
  derived and/or modified sequence opt5 from hemagglutinin__InfluenzaA__ACF54510

SEQ ID NO: 185376 - RNA, 1689 nt, Artificial Sequence; identical to SEQ ID NO: 185374
  derived and/or modified sequence opt5 from hemagglutinin__InfluenzaA__ACF54521

SEQ ID NO: 185377 - RNA, 1701 nt, Artificial Sequence
  derived and/or modified sequence opt5 from hemagglutinin__InfluenzaA__ACF54532
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcauuggccaggcugccgaccugaaaucuacacaagcugccaucgaucagauuaaugggaagcucaaccggcugaucggaaaaaccaacgaaaaguuccaccagauugagaaggaauuuagcgagguggaaggcagaauccaggaccuugagaaauacgucgaggauacgaagauugaccugugguccuauaaugccgaacuccugguggcucuggagaaccaacauacaaucgaucucaccgacagcgaaaugaauaaacuguucgagaagaccaaaaagcagcuucgcgaaaacgcggaggauauggggaauggaugcuuuaagaucuaccacaaaugugacaacgccugcauuggcucuauccggaaugggacauaugaucaugacguuuacagagacgaggcucugaacaaucgcuuccagauuaagggcguggaacucaccuccggauacaaagauuggauccuguggauuagcuuugccaucucuugcuuccuucugugugucgcccuccugggcuuuaucaugugggcuugccagaaggggaacauucgguguaauaucugcauuuga

SEQ ID NO: 185378 - RNA, 1701 nt, Artificial Sequence
  derived and/or modified sequence opt5 from hemagglutinin__InfluenzaA__ACF54543
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacguuucucuccggagccugguggcuuccagcgggacgcuugaauuuaacaaugagucuuucaacuggaccggagucacacagaauggcaccuccagcgccugcauccgcagaucuaacaauuccuuuuucagccggcugaacuggcucacacaucugaaguuuaaguauccugcucuuaaugugaccaugcccaacaacgagaauuucgacaaacuguacauuuggggcguucaccauccugggacggauaacgaccagaucuuucucuaugcccaggcgucuggacgcauuacaguguccaccaagagaagccaacagacagucaucccgaauauuggcucccggccccgcgugagaaacaucccuucucggaucagcauuuacuggaccaucgugaaacccggggauauucugcugaucaauuccaccggaaaccucauugccccucgcggcuacuucaagaucagaagcgggaaaucuuccaucaugcggagcgacgcucccauuggaaaguguaauucugaaugcaucacaccgaacggcagcauuccuaaugacaagcccuuucagaacgucaaucgcaucacguauggcgccuguccuagauacguuaaacagaacacccugaaacuugcuacagggaugcggaaugugcccgagaagcaaacccgcggaauuuucggcgccaucgcgggguuuaucgaaaacggaugggagggcaugguggaugggugguauggauucagacaccaaaauuccgagggcauuggccaggccgcugaccugaagucuacacaggccgcuaucgaucagauuaacgggaaacucaaccggcugaucggaaagaccaaugaaaaauuccaccagauugagaaggaauuuagcgaggucgaaggcagaauccaggaccuugagaaguacguggaggauacgaaaauugaccugugguccuauaacgccgaacuccugguugcccuggagaaucaacauacaaucgaucucaccgacagcgaaaugaacaagcuguucgagaaaaccaagaaacagcuucgcgaaaaugcugaggaucuggggaacggaugcuuuaagaucuaccacaagugugacaaugcgugcauuggcucuauccggaacgggacauaugaucaugacguguacagagacgaggcccucaauaaccgcuuccagauuaaaggcgucgaacugaaguccggauacaaagauuggauccuuuggauuagcuuugcuaucucuugcuuccugcucuguguggcccugcugggcuuuaucaugugggccugccagaaggggaauauucgguguaacaucugcauuuga

SEQ ID NO: 185379 - RNA, 1701 nt, Artificial Sequence
  derived and/or modified sequence opt5 from hemagglutinin__InfluenzaA__ACF54565
augaagaccaucauugcccugagcuacauccucugccugguguucucccagaaacuucccggcaacgacaauucuacagcuacgcugugucucgggcaccaugccgucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgauuacgccagccuccggucccugguugcuagcucuggaacgcuugaguuuaacaaugaauccuucaacugggccggcgugacccagaauggcacaagcucugcuugcaagcgcagauccaacaagagcuuuuucucucggcugaauuggcucacccaucugaaauauaaguacccugcccuuaacgucacaaugcccaauaacgagaaauuugacaagcuguauaucuggggagugcaccauccuguuaccgauuccgaccagauuagccucuacgcgcaggccuccgggcgcaucacggugucuacaaaaagaagccaacagaccgucauuccgaacaucggcuaccggccccgcgugagagauauuuccagccggaucucuaucuauuggacaauugugaagccuggggacauccugcugauuaauuccaccggaaaccucaucgcuccccgcggcuacuucaagauuagaagcgggaaaucuagcaucaugcgguccgacgccccuaucggaaaguguaauucugagugcauuacccccaacggcagcaucccgaaugauaaaccuuuucagaacgucaaucgcauuacauauggcgcuugucccagauacguuaagcagaacacgcugaaacuugccaccgggaugcggaaugugccugaaaagcaaacacgcggaaucuucggcgcgauugccggguuuaucgagaacggaugggaaggcaugguggacgggugguauggauucagacaccaaaauuccgagggcaccggccaggcugccgaucugaaaagcacacaggcugccaucaaccagauuaaugggaagcucaaccggcugaucggaaagaccaaugagaaauuucaccagauugaaaaggaguucucugaagucgagggcagaauccaggaccuugaaaaauacguggaggauacgaagauugaccugugguccuauaacgccgagcuccugguugcucuggaaaaccaacauacaaucgaucucaccgacagcgagaugaauaaacuguucgaacgcaccaagaagcagcuucgggagaacgcggaagauauggggaauggaugcuuuaaaauuuaccacaagugugacaacgccugcaucgagucuaucagaaauggcacauacgaucaugacguguaucgcgacgaggcucugaacaaucgguuccagauuaaaggggucgaacucaaguccggcuacaaagauuggauccuguggauuagcuuugccaucuccugcuuccuucuguguguggcccuccugggauuuauuaugugggcuugccagaagggcaacaucagauguaauaucugcauuuga

SEQ ID NO: 185380 - RNA, 1701 nt, Artificial Sequence
  derived and/or modified sequence opt5 from hemagglutinin__InfluenzaA__ACF54576
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacgacgaaucuuucaauuggaccggcgugacacagaacggcaccuccagcucuugcaagcgcagauccaauaacagcuuuuucucucggcugaauuggcucacacagcugaaguuuaaauauccugcucuuaacgucaccaugcccaauaacgagaaguucgauaaacuguacaucuggggagugcaucacccuguuacggacaacgaucagauuuuucucuaugcccaagcguccgggcgcaucacagugagcaccaagagaucccagcagacagucauuccgaauaucggcucucggccccgcauuagaaacaucccuagccggaucuccauuuacuggaccaucgugaaacccggggacauucugcugaucaauagcaccggaaaccucauugccccucgcggcuacuucaagaucagaucugggaaguccagcaucaugcggucugacgcucccauuggaaaauguaauagcgagugcaucacaccgaacggcuccauuccuaaugauaagcccuuucagaacgugaaucgcaucacguauggcgccuguccuagauacgucaaacaaaacacccugaagcuggcuacagggaugcggaauguucccgaaaaacagacccgcggaauuuucggcgccaucgcgggguuuaucgagaacggaugggaaggcaugguggacgggugguauggauucagacaucaaaauucugagggcauuggccaggccgcugaucuuaagagcacacaggccgcuaucaaccagauuaaugggaaacucaaccggcugaucggaaagaccaacgagaaguuccaccagauugaaaaagaguuuuccgaaguggagggcagaauccaagaccuugaaaaguacgucgaggauacgaaaauugaccuguggagcuauaaugccgagcuccugguggcccuggaaaaccagcacacaaucgaucucaccgacucugagaugaauaagcuguucgaacgcaccaaaaagcagcuucgggagaacgcugaagauauggggaauggaugcuuuaagaucuaccauaaaugugacaacgcgugcauuggcuccaucagaaaugggacauaugaucacgacguuuaccgcgacgaggcccugaacaaucgguuccagauuaagggcguggagcucaaaagcggauacaaggauuggauccuguggauuucuuuugcuaucuccugcuuccuucugugugucgcccuccugggcuuuaucaugugggccugccaaaaagggaacauuagauguaauaucugcauuuga

SEQ ID NO: 185381 - RNA, 1698 nt, Artificial Sequence
  derived and/or modified sequence opt5 from hemagglutinin__InfluenzaA__ACF54598
augaaggccaaacugcucgugcugcuuuacgcuuucgucgccaccgacgcggauacaaucugcauuggcuaucacgcuaacaauagcacggacaccguugauacaaucuuugagaagaacguggccgugacccauuccgucaaucugcucgaagacagacacaacgggaaacuguguaaacuuaagggaauugcuccccugcagcucggcaagugcaauaucauuggguggcugcugggaaacccugagugugauucucuccugccggcccggagcugguccuacaucguggaaacacccaauucugagaacggcgccugcuauccuggggacuucaucgauuacgaagaacuucgcgagcaacugagcuccguuucuagccucgaaagauuugagauuuuccccaaggaauccagcuggccuaaucauaccuuuaacggagugacagcuucuuguucccaccggggcaaaagcucuuucuaucgcaaucugcuuuggcugaccaagaaaggcgacuccuaccccaagcucacgaacagcuaugucaauaacaaagggaaggaggugcugguucuguggggagugcaucacccuucuuccagcgaugagcagcagucccucuacucuaauggcaacgccuacgucagcguggcguccagcaacuauaauagacgguuuaccccggaaaucgccgcucgccccaaggugaaagaccagcacgggagaaugaacuacuauuggacacugcuugagccuggagauaccauuaucuucgaagccacaggcaaucugauugcucccugguacgccuuugcgcucucucggggguucgaguccggaaucauuaccagcaacgccucuaugcaugaaugcaauacgaagugucaaacaccucagggcagcaucaacuccaaucugcccuuucagaacauccacccggucaccauuggcgagugcccuaaauauguucgcucuacaaagcugagaauggugaccgggcuucggaauauccccagcauucaguaccgcggacucuucggcgcuaucgccggguuuauugagggaggcuggaccgggaugaucgacggaugguauggcuaccaucaccaaaacgaacagggcuccggguacgcugccgaucagaaaagcacacagaaugccaucaacggaauuacgaauaaggugaacucuaucauugagaaaaugaauacccaauucacagcugucggcaaggaguucaacaaccuggagaagagaauggaaaaucugaacaaaaagguggacgacggguuucucgauaucuggaccuauaaugcggagcugcuuguucugcucgagaacggacggacacuggacuuccacgaucuuaaugugaaaaaccuguacgaaaaggucaaaucccagcucaagaauaacgccaaggagauuggcaauggguguuuugaguucuaucauaaaugcgacaacgaauguauggaaagcgugcgcaauggcaccuacgauuauccuaaguacucugaggaguccaaacugaacagagaaaagaucgacggaguuaaacuggagagcaugggcguguaucagauccucgcuauuuacuccacggucgccucuagccuggugcuucuggucucccucggggccaucucuuuuuggaugugcagcaauggaucccugcaaugccggauuuguaucuga

SEQ ID NO: 185382 - RNA, 1704 nt, Artificial Sequence
  derived and/or modified sequence opt5 from hemagglutinin__InfluenzaA__ACG50699
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauggucgagaaggcuaaccccgccaaugaucugugcuacccuggaaacuuuaaugacuaugaggaacucaagcaucugcuuucucggauuaaccacuucgagaaaauccagauuauccccaagagcuccuggucugaucaugaagccagccugggcguguccagcgcuuguccuuaccaggggucuuccagcuuuuuccgcaauguuguguggcucauuaaaaagaacaaugccuaucccaccaucaaaagaucuuacaacaauacaaaccaagaggaccugcuuguccuguggggcauucaccacccuaacgaugaggcugaacagacccggcucuaucagaauccgacaaccuacaucuccgugggaacgagcacccugaaccagcgccugauccccaagauugccacaagaucuaaggugaauggccaauccgggcggauggacuuuuucuggaccauccucaaaccuaacgaugcgauuaauuuugagagcaacggaaauuucaucgcccccgaauacgcuuauaagauugucaaaaagggcgacuccgccaucaugaaaucugagguugaauacgggaacugcaauacaaagugucagaccccuaugggagcuaucaacagcuccaugcccuuucauaauauucacccgcugacgaucggcgagugcccuaaauaugucaagagcaacaaacuugugcuggccacagggcuccgcaauucuccccagagagagcggcgcagaaaacggggacuguucggcgcgauugccggcuuuaucgaagggggauggcagggcaugguggacgggugguacggauaucaucacuccaacgagcaaggcagcggguacgcugccgauaaggaaucuacccagaaagcuauugacggagugacaaauaagguuaacagcaucaucgauaaaaugaacacccaguucgaggccgugggccgcgaauuuaauaaccuugagagacggauugagaaucugaacaagaagauggaagacggcuuccucgaugucuggaccuauaaugccgagcugcuggugcucauggaaaacgagcgcacacuggacuuccacgauuccaauguuaaaaaccuuuacgacaaggugagacugcaacuccgggauaaugcuaaagaacuggggaacggauguuuugaguucuaccauaagugcgacaaugaguguauggaaucugucagaaacggcacguaugauuacccucaguauagcgaggaagcgcgccuuaaacgggaggagaucuccggggugaagcuggaaagcauuggaaccuaccagauccucucuauuuauuccacagucgccagcucucuggcucuggccaucaugguggccggccucucccuguggaugugcagcaaugggucccuucagugcagaauuuguaucuga

SEQ ID NO: 185383 - RNA, 1701 nt, Artificial Sequence; identical to SEQ ID NO: 184952
  derived and/or modified sequence opt5 from hemagglutinin__InfluenzaA__ACG70142

SEQ ID NO: 185384 - RNA, 1701 nt, Artificial Sequence; identical to SEQ ID NO: 184952
  derived and/or modified sequence opt5 from hemagglutinin__InfluenzaA__ACG70153

SEQ ID NO: 185385 - RNA, 1701 nt, Artificial Sequence
  derived and/or modified sequence opt5 from hemagglutinin__InfluenzaA__ACG80410
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaagaaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggagugacacagaauggcaccuccagcgcuugcaucagacggucuaacaauuccuuuuucagccgccugaacuggcucacacaucugagauuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaagcgcagccagcagacagugaucccgaacauuggcuccagaccccggguccgcaauaucccuucuagaaucagcauuuacuggaccaucgugaaacccggggauauucugcugaucaacuccaccggaaaucucauugcuccucggggcuacuucaagauccgcaacgggaaaagcucuaucaugagauccgacgcccccauuggaaaguguaauagcgaaugcaucacaccgaacggcucuauuccuaaugacaaacccuuucagaacgugaaucggaucacguauggcgcuuguccucgcuacgucaagcaaaacacccugaaacuugccacagggaugagaaauguucccgagaagcagacccggggaauuuucggcgcgaucgccggguuuaucgaaaacggaugggagggcaugguggaugggugguauggauucagacaccagaauagcgagggccgcggccaagcugccgaccugaaguccacacaggcugccauugaucagaucaacgggaaacucaaccggcugauuggaaagaccaaugaaaaauuccaccagaucgagaaggaauuuucugagguggaaggccgcauucaagaccuugagaaauacgucgaggauacgaagaucgaccuguggagcuauaacgccgaacuccugguggcucuggagaaucagcauacaauugaucucaccgacuccgaaaugaacaagcuguucgagaaaaccaagaaacagcuuagagaaaaugcggaggauauggggaacggaugcuuuaagaucuaccacaaaugugacaaugccugcaucggcagcauucggaacgggacauaugaucaugacguuuacagagacgaggcucugaauaaccgcuuccagaucaagggcguggaacucaagucuggauacaaagauuggauucuguggaucuccuuugccauuagcugcuuccuucugugugucgcccuccugggcuuuaucaugugggcuugccaaaaggggaauauccgguguaacauuugcaucuga

SEQ ID NO: 185386 - RNA, 1701 nt, Artificial Sequence
  derived and/or modified sequence opt5 from hemagglutinin__InfluenzaA__ACG80420
augcagaccaucauugcccugagcuacauccucugccugguguucgcucaaaaacuucccggcaacgacaauuccacagccacgcugugucucgggcaccaugcggucccuaacggaaccauuguuagaacaaucaccaaugaucagauugaggugacaaacgcuaccgaacuggugcagucuagcuccacaggcgagaucugcgacucuccgcaccagauccuugauggggaaaauuguacccugauugacgcccuccugggagauccccaaugcgacggcuuucagaacaagaagugggaucuguucgucgagcggagcaaagccuauuccaauuguuacccuuaugacgugcccgauuacgcuucucuccgcagccugguugccuccagcgggacgcuugaauuuaacaaugagucuuucaacuggaccggagugacacagaauggcaccuccagcgcuugcaucagacggucuaacaauuccuuuuucagccgccugaacuggcucacacaucugagauuuaaguauccugcccuuaaugucaccaugcccaacaacgagcaguucgacaaacuguacauuuggggcgugcaccauccugggacggauaaugaccaaaucuuucucuaugcgcaggccucuggacggauuacaguuuccaccaagcgcagccagcagacagugaucccgaacauuggcuccagaccccggguccgcaauaucccuucuagaaucagcauuuacuggaccaucgugaagcccggggauauucugcugaucaacuccaccggaaaucucauugcuccucggggcuacuucaaaauccgcaacggaaagagcucuaucaugagauccgacgcccccauugggaaauguaauagcgaaugcaucacaccgaacggcucuauuccuaaugacaagcccuuucaaaacgugaaucggaucacguauggcgcuuguccucgcuacgucaaacagaacacccugaaacuugccacagggaugagaaauguucccgagaagcagacccggggaauuuucggcgcgaucgccggguuuaucgaaaacggaugggagggcaugguggaugggugguauggauucagacaccaaaauagcgagggccgcggccaggcugccgaccugaaguccacacaggcugccauugaucagaucaacgggaagcucaaccggcugauuggaaaaaccaaugaaaaguuccaccaaaucgagaaagaauuuucugagguggaaggccgcauucaggaccuugagaaguacgucgaggauacgaaaaucgaccuguggagcuauaacgccgaacuccugguggcucuggagaaucagcauacaauugaucucaccgacuccgaaaugaacaagcuguucgagaagaccaaaaagcagcuuagagaaaaugcggaggauauggggaacggaugcuuuaaaaucuaccacaagugugacaaugccugcaucggcagcauucggaacgggacauaugaucaugacguuuacagagacgaggcucugaauaaccgcuuccaaaucaaaggcguggaacucaagucuggauacaaggauuggauucuguggaucuccuuugccauuagcugcuuccuucugugugucgcccuccugggcuuuaucaugugggcuugccagaaagggaauauccgguguaacauuugcaucuga

SEQ ID NO: 185387 - RNA, 1701 nt, Artificial Sequence; identical to SEQ ID NO: 185385
  derived and/or modified sequence opt5 from hemagglutinin__InfluenzaA__ACG80426

SEQ ID NO: 185388 - RNA, 1701 nt, Artificial Sequence; identical to SEQ ID NO: 185385
  derived and/or modified sequence opt5 from hemagglutinin__InfluenzaA__ACG80430

SEQ ID NO: 185389 - RNA, 1701 nt, Artificial Sequence
  derived and/or modified sequence opt5 from hemagglutinin__InfluenzaA__ACG80436
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaagugggaucuguuugucgagagaagcaaagccuauuccaauuguuacccuuaugacgugcccgauuacgcuucucugcggagccucguugccuccagcgggacgcuggaguucaacaaugaaucuuuuaacuggaccggagugacacagaauggcaccuccagcgcuugcauccgcagaucuaacaauuccuucuuuagccggcuuaacuggcugacacaucuccgcuucaaguauccugcccugaaugucaccaugcccaacaacgagaauuuugacaaacuuuacauuuggggcgugcaccauccugggacggauaacgaccagaucuuccuguaugcgcaggccucuggaagaauuacaguuuccaccaagcggagccaacagacagugaucccgaauauuggcucccgccccagaguccggaacaucccuucucgcaucagcauuuacuggaccaucgugaagcccggggauauucuccugaucaauuccaccggaaaccugauugcuccuagaggcuacuuuaaaauccggagcgggaagucuuccaucaugcgcagcgacgcccccauuggaaaauguaauucugaaugcaucacaccgaacggcagcauuccuaaugacaagcccuuccagaacgugaauagaaucacguauggcgcuuguccucgguacgucaagcagaacacccucaaacuggccacagggaugcgcaauguucccgagaagcaaaccagaggaauuuuuggcgcgaucgccggguucaucgaaaacggaugggagggcaugguggaugggugguauggauuccggcaccaaaauuccgagggcauuggccaggcugccgaccuuaaaucuacacaggcugcccuggaucagaucaacgggaagcucaacagacugauuggaaaaaccaaugaaaaguuucaccagaucgagaaagaguucagcgaaguggaaggccgcauucaggaccuugagaaguacgucgaggauacgaagaucgaccugugguccuauaacgccgaacuccugguggcucuggagaaucaacauacaauugaucucaccgacagcgaaaugaacaaacuguuugagaagaccaaaaagcagcuucgggaaaaugcggaggauauggggaacggaugcuucaaaaucuaccacaagugugacaaugccugcaucggcucuauuagaaacgggacauaugaucauaauguuuaccgcgacgaggcucugaacaaucgguuucagaucaagggcguggaacucaaauccggauacaaggacuggauucuguggaucagcuucgccauuucuugcuuucuucugugugucgcccuccugggcuucaucaugugggcuugccagaaagggaacaucagauguaauauuugcaucuga

SEQ ID NO: 185390 - RNA, 1701 nt, Artificial Sequence
  derived and/or modified sequence opt5 from hemagglutinin__InfluenzaA__ACG80445
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaagaaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggagugacacagaauggcaccuccagcgcuugcaucagacggucuaacaauuccuuuuucagccgccugaacuggcucacacaucugagauuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaagcgcagccagcagacagugaucccgaacauuggcuccagaccccggguccgcaauaucccuucuagaaucagcauuuacuggaccaucgugaaacccggggauauucugcugaucaacuccaccggaaaucucauugcuccucggggcuacuucaagauccgcaacgggaaaagcucuaucaugagauccgacgcccccauuggaaaguguaauagcgaaugcaucacaccgaacggcucuauuccuaaugacaaacccuuucagaacgugaaucggaucacguauggcgcuuguccucgcuacgucaagcaaaacacccugaaacuugccacagggaugagaaauguucccgagaagcagacccggggaauuuucggcgcgaucgccggguuuaucgaaaacggaugggagggcaugguggaugggugguauggauucagacaccagaauagcgagggccgcggccaagcugccgaccugaaguccacacaggcugccauugaucagaucaacgggaaacucaaccggcugauuggaaagaccaaugaaaaauuccaccagaucgagaaggaauuuucugagguggaaggccgcauucaagaccuugagaaauacgucgaggauacgaagaucgaccuguggagcuauaacgccgaacuccugguggcucuggagaaucagcauacaauugaucucaccgacuccgaaaugaacaagcuguucgagaaaaccaagaaucagcuuagagaaaacgcggaggauauggggaauggaugcuuuaaaaucuaccacaagugugacaacgccugcaucggcagcauucggaaugggacauaugaucaugacguuuacagagacgaggcucugaacaaucgcuuccagaucaaaggcguggaacucaagucuggauacaaggauuggauucuguggaucuccuuugccauuagcugcuuccuucugugugucgcccuccugggcuuuaucaugugggcuugccaaaaagggaacauccgguguaauauuugcaucuga

SEQ ID NO: 185391 - RNA, 1701 nt, Artificial Sequence; identical to SEQ ID NO: 185385
  derived and/or modified sequence opt5 from hemagglutinin__InfluenzaA__ACG80454

SEQ ID NO: 185392 - RNA, 1701 nt, Artificial Sequence; identical to SEQ ID NO: 185385
  derived and/or modified sequence opt5 from hemagglutinin__InfluenzaA__ACG80463

SEQ ID NO: 185393 - RNA, 1701 nt, Artificial Sequence
  derived and/or modified sequence opt5 from hemagglutinin__InfluenzaA__ACG80472
augaagaccaucauugcccugagcuacauccucugccugguguucgcucagaaacuucccggcaacgacaauuccacagccacgcugugucucgggcaccaugcggucccuaacggaaccauuguuagaacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaagaaaugggaucuguucgucgagcggagcaaggccuauuccaauuguuacccuuaugacgugcccgauuacgcuucucuccgcagccugguugccuccagcgggacgcuugaauuuaacaaugagucuuucaacuggaccggagugacacagaauggcaccuccagcgcuugcaucagacggucuaacaauuccuuuuucagccgccugaacuggcucacacaucugagauuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaagcgcagccagcagacagugaucccgaacauuggcuccagaccccggguccgcaauaucccuucuagaaucagcauuuacuggaccaucgugaaacccggggauauucugcugaucaacuccaccggaaaucucauugcuccucggggcuacuucaagauccgcagcgggaaaucuuccaucaugagaagcgacgcccccauuggaaaguguaacucugaaugcaucacaccgaauggcagcauuccuaacgacaaacccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugguggaugggugguauggauucagacaccagaacuccgagggcauuggccaagcugccgaccugaagucuacacaggcugcccucgaucagaucaaugggaaacugaaccgccuuauuggaaagaccaacgaaaaauuccaccagaucgagaaggaauuuagcgagguggaaggccggauucaagaccuggagaaauacgucgaggauacgaagaucgaccucugguccuauaaugccgaacugcugguggcucucgagaaccagcauacaauugaucugaccgacagcgaaaugaauaaacuuuucgagaagaccaagaaacagcugagagaaaacgcggaggauauggggaauggaugcuuuaagaucuaccacaaaugugacaacgccugcaucggcucuauucgcaaugggacauaugaucauaacguuuaccgggacgaggcucucaauaacagauuccagaucaagggcguggaacugaaguccggauacaaagacuggauucuuuggaucagcuuugccauuucuugcuuccugcucugugucgcccugcugggcuuuaucaugugggcuugccaaaaggggaauauccgcuguaacauuugcaucuga

SEQ ID NO: 185394 - RNA, 1701 nt, Artificial Sequence
  derived and/or modified sequence opt5 from hemagglutinin__InfluenzaA__ACH69558
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaacuccuuuuucagccggcugaauuggcucacacaucugcgcuuuaaguauccugcccuuaacgucaccaugcccaacaaugagaaauucgauaagcuguacaucuggggagugcaccauccugggacggacaacgaucagauuuuucucuaugcgcaggccucuggcagaaucacaguuuccaccaaacggagccaacagacagugauuccgaauaucgggucccgccccagaguccggaacauuccuucucgcaucagcaucuacuggaccauugugaagcccggagacauccugcugauuaauuccaccggcaaccucaucgcuccuagaggguacuucaaaauucggagcggaaagucuuccaucaugcgcagcgaugcccccaucggcaaguguaauucugagugcauuacaccgaacggcagcaucccuaaugacaaacccuuucagaacgugaauagaauuacguauggggcuuguccucgguacgucaagcagaacacccugaaacuugccacaggaaugcgcaauguucccgaaaagcaaaccagaggcaucuucggggcgauugccggauuuaucgagaacggcugggaagggaugguggacggaugguauggcuuccggcaccaaaauuccgagggcaucgggcaggcugccgaucugaaaucuacacaggcugccauuaaccagaucaacggaaagcucaauagacugauuggcaaaaccaacgagaaguuccaccagaucgaaaaggaguuuagcgaaguggaggggcgcauucaggaccuugaaaaauacgucgaggauacgaagaucgaccugugguccuauaaugccgagcuccugguggcucuggaaaaccaacauacaauugaucucaccgacagcgagaugaauaaacuguucgaacggaccaagaaacagcuuagagagaacgcggaagauaugggaaauggcugcuuuaagaucuaccacaagugugacaacgccugcaucgggucuauucgcaauggcacauaugaucaugacguuuaccgggaugaggcucugaacaauagauuccagaucaaaggaguggagcucaaguccggcuacaaagacuggauucuguggaucagcuuugccauuucuugcuuccuucugugugucgcccuccugggguuuaucaugugggcuugccagaagggaaacauccgcuguaauauuugcaucuga

SEQ ID NO: 185395 - RNA, 1701 nt, Artificial Sequence
  derived and/or modified sequence opt5 from hemagglutinin__InfluenzaA__ACH69569
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcaauucuccgcaccagauccuugacggagagaacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucaauuggaccggcgugacacagaacggcaccuccagcgcuugcaagcgcagaucuaauaacuccuuuuucagccggcugaauuggcucacacaucugaaguuuaaauauccugcccuuaacgucaccaugcccaacaaugagaaguucgauaaacuguacaucuggggagugcaccauccugggacggacaacgaucagauuuuucucuaugcgcaggccucuggccgcaucacaguuuccaccaagagaagccaacagacagugauuccgaauaucgggucccggccccgcgucagaaacauuccuucucggaucagcaucuacuggaccauugugaaacccggagacauccugcugauuaauuccaccggcaaccucaucgcuccucgcggguacuucaagauuagaagcggaaagucuuccaucaugcggagcgaugcccccaucggcaaauguaauucugagugcauuacaccgaacggcagcaucccuaaugacaagcccuuucagaacgugaaucgcauuacguauggggcuuguccuagauacgucaaacagaacucccugaagcuggccaccggaaugcggaauguucccgaaaaacaaacacgcggcaucuucggggcgauugccggauuuaucgagaacggcugggaagggaugguggacggaugguauggcuucagacaccaaaauucugagggcaucgggcaggcugccgaucuuaagagcacccaggcugccauuaaccagaucaacggaaaacucaaucggcugauuggcaagacaaacgagaaguuccaccagaucgaaaaagaguuuuccgaaguggaggggcgcauucaggaccuugaaaaguacgucgaggauaccaaaaucgaccuguggagcuauaaugccgagcuccugguggcucuggaaaaccaacauacgauugaucucacagacucugagaugaauaagcuguucgaaagaaccaaaaagcagcuucgggagaacgcggaagauaugggaaauggcugcuuuaagaucuaccacaaaugugacaacgccugcaucggguccauuagaaauggcaccuaugaucaugacguuuaccgcgaugaggcucugaacaaucgguuccagaucaagggaguggagcucaaaagcggcuacaaggacuggauucuguggaucucuuuugccauuuccugcuuccuucugugugucgcccuccugggguuuaucaugugggcuugccagaaaggaaacaucagauguaauauuugcaucuga

SEQ ID NO: 185396 - RNA, 1701 nt, Artificial Sequence
  derived and/or modified sequence opt5 from hemagglutinin__InfluenzaA__ACH69580
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacgauuuucaaaacaaaaagugggaccuguucgucgaaagaagcaaagccuauuccaauuguuacccuuaugaugugcccgacuacgcuucucuccggagccugguugccuccagcgggacgcuugaguuuaacaaugaaucuuucaacuggaccggagugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgauaaacuguacaucuggggcgugcaccauccugggacggacaaugaucagauuuuucucuaugcgcaggccucuggacgcaucacaguuuccaccaagagaagccaacagacagugauuccgaacaucggcucccggccccgcgucagaaauauuccuucucggaucagcaucuacuggaccauugugaaacccggggacauccugcugauuaacuccaccggaaaucucaucgcuccucgcggcuacuucaagauuagaagcgggaagucuuccaucaugcggagcgacgcccccaucggaaaauguaacucugagugcauuacaccgaauggcagcaucccuaacgauaagcccuuucagaaugugaaccgcauuacguauggcgcuuguccuagauacgucaaacagaauacccugaaacuugccacagggaugcggaacguucccgaaaagcaaacccgcggaaucuucggcgcgauugccggguuuaucgagaauggaugggaaggcaugguggacgggugguauggauucagacaccagaacuccgagggcaucggccaggcugccgaucugaagucuacacaagcugccauuaaucagaucaacgggaaacucaaccggcugauuggaaagaccaaugagaaguuccaccagaucgaaaaagaguuuagcgaaguggagggccgcauucaggaccuugaaaaguacgucgaggauacgaaaaucgaccugugguccuauaacgccgagcuccugguggcucuggaaaaucaacauacaauugaucucaccgacagcgagaugaacaagcuguucgaaagaaccaaaaagcagcuucgggagaaugcggaagauauggggaacggaugcuuuaagaucuaccacaaaugugacaaugccugcaucggcucuauuagaaacgggacauaugaucaugacguuuaccgcgacgaggcucugaauaaccgguuccagaucaagggcguggagcucaaauccggauacaaggauuggauucuguggaucagcuuugccauuucuugcuuccuucugugugucgcccuccugggcuuuaucaugugggcuugccagaaagggaauaucagauguaacauuugcaucuga

SEQ ID NO: 185397 - RNA, 1701 nt, Artificial Sequence
  derived and/or modified sequence opt5 from hemagglutinin__InfluenzaA__ACH69591
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaacuccuuuuucagccgccucaauuggcugcaccagcuuaaguauagauacccugcccugaacgugaccaugcccaauaacgacaaguuugauaaacucuauaucuggggcguccaucacccuucuacagacuccgaucagauuagcguguacgcucaggccuccgggcggguuaccgugucuacgaagcgcagccaacagacagucaucccgaacauuggauccagacccugggugcggggcaucagcucucgcauuuccaucuacuggaccaucgugaaaccuggggacauucugcugaucaauagcacaggaaaccucauugcucccagaggcuauuucaagauccggucugggaaaagcuccauuaugcgcucugacgccccuaucggaaaguguaauagcgagugcaucacccccaacggcuccauuccgaaugauaagccuuuucagaacgucaauagaaucaccuacggcgcguguccccgguauguuaaacagaacacacugaaacuugccacggggaugcgcaaugugccugaaaagcaaaccagaggaauuuucggcgcuaucgccggguuuauugagaacggaugggaaggcaugauggacgggugguacggauuccggcaccagaauagcgagggcacaggccaggcugccgaucugaagucuacccaagccgcuaucaaccagaucaaugggaaacucaacaagcugauugagaaaacaaaugaaaaguuucaucagaucgagaacgaguucuccgaaguggaaggacgcauucaggaccuugagaaguaugucgaggauaccaaaaucgaccuguggagcuacaacgcggaacuccugguggcccuggagaaucaacacacgauugaucucacagacucugaaaugaacaagcuguucgagagaacccggaaacagcuuagagaaaaugcugaggauaugggcaacgggugcuuuaagaucuaucauaaaugugacaaugccugcauuggauccauccgcaacggcaccuacgaucacgacguuuaccgggacgaggcccugaauaacagauuccagaucaaggggguggaacucaagagcggcuauaaagauuggauucuguggaucuccuuugcuauuucuugcuuccuucugugugucgugcuccugggauuuaucaugugggccugccagaagggcaauauucgcuguaacaucugcaucuga

SEQ ID NO: 185398 - RNA, 1701 nt, Artificial Sequence
  derived and/or modified sequence opt5 from hemagglutinin__InfluenzaA__ACH69602
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccaauuguuacccuuaugacguccccgauuacgccucucugcgcagccuuguggcuuccagcgggacgcuggaauuuaacaaugagucuuucaacuggaccggaguugcccaaaauggcacauccagcgcgugcaaaagacggucuauuaacuccuuuuucagccgccucaauuggcugcaccagcuuaaguauagauacccugcccugaacgugaccaugcccaauaacgacaaguuugauaaacucuauaucuggggcguccaucacccuucuacagacuccgaucagauuagcguguacgcucaggccuccgggcggguuaccgugucuacgaagcgcagccaacagacagucaucccgaacauuggauccagacccugggugcggggcaucagcucucgcauuuccaucuacuggaccaucgugaaaccuggggacauucugcugaucaauagcacaggaaaccucauugcucccagaggcuauuucaagauccggucugggaaaagcuccauuaugcgcucugacgccccuaucggaaaguguaauagcgagugcaucacccccaacggcuccauuccgaaugauaagccuuuucagaacgucaauagaaucaccuacggcgcguguccccgguauguuaaacagaacacacugaaacuugccacggggaugcgcaaugugccugaaaagcaaaccagaggaauuuucggcgcuaucgccggguuuauugagaacggaugggaaggcaugauggacgggugguacggauuccggcaccagaauagcgagggcacaggccaggcugccgaucugaagucuacccaagccgcuaucaaccagaucaaugggaaacucaacaagcugauugagaaaacaaaugaaaaguuucaucagaucgagaaggaguucuccgaaguggaaggacgcauucaggaccuugagaaauaugucgaggauaccaagaucgaccuguggagcuacaacgcggaacuccugguggcccuggagaaccaacacacgauugaucucacagacucugaaaugaauaaacuguucgagagaacccggaagcagcuuagagaaaacgcugaggauaugggcaaugggugcuuuaaaaucuaucauaagugugacaacgccugcauuggauccauccgcaauggcaccuacgaucacgacguuuaccgggacgaggcccugaacaauagauuccagaucaaggggguggaacucaaaagcggcuauaaggauuggauucuguggaucuccuuugcuauuucuugcuuccuucugugugucgugcuccugggauuuaucaugugggccugccagaaaggcaacauucgcuguaauaucugcaucuga

SEQ ID NO: 185399 - RNA, 1701 nt, Artificial Sequence
  derived and/or modified sequence opt5 from hemagglutinin__InfluenzaA__ACH69613
augaagaccaucauugcccugagcuacauccucugccuggcuuucgcccagaaacuucccggcaacgacaauuccacaccuacgcugugucucgggcaccaugcggugccgaacggaacccuggucaagacaauuaccaaugaucaaaucgagguuacaaacgcuaccgaacuugugcagucuagcuccacaggcgggauuugcgacucuccccaccagaucaucgauggagagaauuguacccugauugacgcccuccugggcgauccucauugcgacggguuucagaacaaagaaugggaucuguucguggagagaagcaaggccuauuccaauuguuaccccuaugacgucccugauuacgcuucucuccggagccugguggccuccagcggaacgcuugaauuuaacaaugagucuuucaacuggaccggcguugcucaaaauggcacauccagcgccugcaaacgcagaucuaucaacuccuuuuucagccggcugaauuggcuccaccagcugaaguaucgcuaccccgcgcuuaacgugaccaugccuaauaacgacaaguuugauaaacuguauauuuggggaguccaucacccgucuacagacuccgaucagaucagcguguacgcccaggcuuccgggagaguuaccgugucuacgaagcggagccaacagacagucauucccaacaucggcucccgcccuugggugagagggauuagcucucggaucuccaucuacuggaccauugugaaacccggagacauccuccugauuaauagcacaggcaacccuaucgcuccccgcggguauuucaagauuagaucuggaaaaagcuccaucaugcggucugacgccccgaucggcaaguguaauagcgagugcauuaccccuaacggcuccauccccaaugauaagccuuuucagaacgucaaucgcauuaccuacggggccugucccagauauguuaaacagaacacacugaagcucgcgacgggaaugcggaaugugcccgaaaaacaaacccgcggcaucuucggggccauugcuggauuuaucgagaacggcugggaagggaugauggacggaugguacggccugagacaccagaauagcgagggcacagggcaggccgcugaucuuaagucuacccaagccgccaucaaccagauuaauggaaaacugaacaagcucaucgagaaaacaaaugaaaaguuccaucagauugagaacgaauuuuccgagguggaaggccggauccaggaccuggagaaguaugucgaggauaccaaaauugaccuuuggagcuacaacgcugaacugcucguggcgcuggagaaucaacacacgaucgaucugacagacucugaaaugaacaagcuguucgagagaacccgcaaacagcugcgggaaaaugccgaggauauggggaacggaugcuucaagauuuaucauaaaugugacaaugcuugcaucggcuccaucagaaacgggaccuacgaucacgacguuuaccgcgacgaggcccuuaauaaccgguuucagauuaagggcguggaacucaagagcggauauaaagauuggauccucuggauuuccuucgccaucucuugcuuucugcuuugugucgugcugcucggcuucauuaugugggcuugccagaaggggaauaucagauguaacaucugcauuuga

SEQ ID NO: 185400 - RNA, 1701 nt, Artificial Sequence; identical to SEQ ID NO: 183654
  derived and/or modified sequence opt5 from hemagglutinin__InfluenzaA__ACH82060

SEQ ID NO: 185401 - RNA, 1701 nt, Artificial Sequence; identical to SEQ ID NO: 185340
  derived and/or modified sequence opt5 from hemagglutinin__InfluenzaA__ACI06123

SEQ ID NO: 185402 - RNA, 1701 nt, Artificial Sequence; identical to SEQ ID NO: 185340
  derived and/or modified sequence opt5 from hemagglutinin__InfluenzaA__ACI06126

SEQ ID NO: 185403 - RNA, 1701 nt, Artificial Sequence; identical to SEQ ID NO: 185340
  derived and/or modified sequence opt5 from hemagglutinin__InfluenzaA__ACI06127

SEQ ID NO: 185404 - RNA, 1701 nt, Artificial Sequence; identical to SEQ ID NO: 185340
  derived and/or modified sequence opt5 from hemagglutinin__InfluenzaA__ACI06129

SEQ ID NO: 185405 - RNA, 1701 nt, Artificial Sequence; identical to SEQ ID NO: 185340
  derived and/or modified sequence opt5 from hemagglutinin__InfluenzaA__ACI06130

SEQ ID NO: 185406 - RNA, 1701 nt, Artificial Sequence; identical to SEQ ID NO: 185340
  derived and/or modified sequence opt5 from hemagglutinin__InfluenzaA__ACI06132

SEQ ID NO: 185407 - RNA, 1701 nt, Artificial Sequence; identical to SEQ ID NO: 185342
  derived and/or modified sequence opt5 from hemagglutinin__InfluenzaA__ACI06133

SEQ ID NO: 185408 - RNA, 1701 nt, Artificial Sequence; identical to SEQ ID NO: 185342
  derived and/or modified sequence opt5 from hemagglutinin__InfluenzaA__ACI06134

SEQ ID NO: 185409 - RNA, 1701 nt, Artificial Sequence; identical to SEQ ID NO: 185342
  derived and/or modified sequence opt5 from hemagglutinin__InfluenzaA__ACI06135

SEQ ID NO: 185410 - RNA, 1701 nt, Artificial Sequence; identical to SEQ ID NO: 185342
  derived and/or modified sequence opt5 from hemagglutinin__InfluenzaA__ACI06136

SEQ ID NO: 185411 - RNA, 1701 nt, Artificial Sequence; identical to SEQ ID NO: 185342
  derived and/or modified sequence opt5 from hemagglutinin__InfluenzaA__ACI06137

SEQ ID NO: 185412 - RNA, 1701 nt, Artificial Sequence; identical to SEQ ID NO: 185342
  derived and/or modified sequence opt5 from hemagglutinin__InfluenzaA__ACI06138

SEQ ID NO: 185413 - RNA, 1701 nt, Artificial Sequence; identical to SEQ ID NO: 185342
  derived and/or modified sequence opt5 from hemagglutinin__InfluenzaA__ACI06139

SEQ ID NO: 185414 - RNA, 1701 nt, Artificial Sequence; identical to SEQ ID NO: 185342
  derived and/or modified sequence opt5 from hemagglutinin__InfluenzaA__ACI06140

SEQ ID NO: 185415 - RNA, 1701 nt, Artificial Sequence; identical to SEQ ID NO: 185342
  derived and/or modified sequence opt5 from hemagglutinin__InfluenzaA__ACI06141

SEQ ID NO: 185416 - RNA, 1701 nt, Artificial Sequence; identical to SEQ ID NO: 185342
  derived and/or modified sequence opt5 from hemagglutinin__InfluenzaA__ACI06142

SEQ ID NO: 185417 - RNA, 1701 nt, Artificial Sequence; identical to SEQ ID NO: 185342
  derived and/or modified sequence opt5 from hemagglutinin__InfluenzaA__ACI06143

SEQ ID NO: 185418 - RNA, 1701 nt, Artificial Sequence
  derived and/or modified sequence opt5 from hemagglutinin__InfluenzaA__ACI06144
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaaccggcuguuugagaagacaagacgccaacuucgggaaaacgccgaggauaugggcaauggaugcuucaaaauuuaucacaagugugacaacgcuugcaucgagucuauuagaaauggcaccuacgaccaugauguuuaucgcgacgaagcgcugaacaaucgguuucagaucaaagggguggagcucaaguccggauacaaagauuggauccuguggauuagcuucgccaucucuugcuuucuucugugugucgugcuccugggcuucauuaugugggcuugccagagagggaacauccgcuguaauauuugcaucuga

SEQ ID NO: 185419 - RNA, 1701 nt, Artificial Sequence; identical to SEQ ID NO: 185342
  derived and/or modified sequence opt5 from hemagglutinin__InfluenzaA__ACI06145

SEQ ID NO: 185420 - RNA, 1701 nt, Artificial Sequence
  derived and/or modified sequence opt5 from hemagglutinin__InfluenzaA__ACI06146
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggauccucuccuugggugcgcggccugagcuccagaauuagcaucuauuggaccaucgucaagcccggcgacguucuggugauuaacucuaaugggaaccucaucgcgccucggggauacuuuaaaaugcgcacaggcaaguccagcauuaugagaucugacgcccccaucgauaccuguauuagcgagugcaucacaccgaauggguccaucccuaacgacaaacccuuccagaaugugaacaagauuaccuacggagcuuguccuaaauaugucaagcagaauacgcugaaacuugccacaggcaugcggaacgugcccgaaaagcagacccgcgggcuguuuggagcuaucgccggcuucauugagaauggcugggaagggaugaucgauggaugguacggcuuuagacaccaaaacuaugaggggaccggacaggcggccgaccucaagucuacacaggcugccauugaucaaaucaauggcaaacugaaccggguuaucgagaagaccaaugaaaaauuccaccagauugagaaggaguucagcgaaguggaagggcgcauccaggaccuugagaaauacgucgaggauacaaagauugaccugugguccuauaacgcugaacuccugguggcccuggagaaucagcauacgaucgaucucaccgacagcgaaaugaacaagcuguuugagaaaacaagacggcaacuuagagaaaacgccgaggauaugggcaauggaugcuucaagauuuaccacaaaugugacaacgcuugcaucgagucuauucgcaauggcaccuaugaccaugauguuuaccgggacgaagcgcugaacaauagauuucagaucaaggggguggagcucaaauccggauacaaggauuggauccuguggauuagcuucgccaucucuugcuuucuucugugugucgugcuccugggcuucauuaugugggcuugccagcgcgggaacauccgguguaauauuugcaucuga

SEQ ID NO: 185421 - RNA, 1701 nt, Artificial Sequence; identical to SEQ ID NO: 185342
  derived and/or modified sequence opt5 from hemagglutinin__InfluenzaA__ACI06147

SEQ ID NO: 185422 - RNA, 1701 nt, Artificial Sequence; identical to SEQ ID NO: 185342
  derived and/or modified sequence opt5 from hemagglutinin__InfluenzaA__ACI06148

SEQ ID NO: 185423 - RNA, 1701 nt, Artificial Sequence
  derived and/or modified sequence opt5 from hemagglutinin__InfluenzaA__ACI06149
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccgccagacgaucauucccaacaucggauccagaccuugggugcggggccugucuagccgcauuuccaucuauuggaccaucgucaagcccggcgacguucuggugauuaacagcaaugggaaccucaucgcgccuagaggauacuuuaaaaugcggacaggcaagucuuccauuaugcgcagcgacgcccccaucgauaccuguauuucugagugcaucacaccgaaugggagcaucccuaacgacaaacccuuccaaaaugugaacaagauuaccuacggagcuuguccuaaauaugucaagcagaauacgcugaaacuugccacaggcaugagaaacgugcccgaaaagcagacccgggggcuguuuggagcuaucgccggcuucauugagaauggcugggaagggaugaucgauggaugguacggcuuucgccaccagaacuccgaggggaccggacaagcggccgaccucaagucuacacaggcugccauugaucagaucaauggcaaacugaacagaguuaucgagaagaccaaugaaaaauuccaccaaauugagaaggaguucagcgaaguggaagggcggauccaggaccuugagaaauaugucgaggauacaaagauugaccugugguccuacaacgcugaacuccugguggcccuggagaaucagcauacgaucgaucucaccgacagcgaaaugaacaagcuguuugagaaaacaagacgccagcuucgggaaaacgccgaggauaugggcaauggaugcuucaagauuuaucacaaaugugacaacgcuugcaucgagucuauuagaaauggcaccuacgaccaugauguuuaucgcgacgaagcgcugaacaaucgguuucaaaucaaggggguggagcucaaauccggauacaaggauuggauccuguggauuagcuucgccaucucuugcuuucuucugugugucgugcuccugggcuucauuaugugggcuugccagagagggaacauccgcuguaauauuugcaucuga

SEQ ID NO: 185424 - RNA, 1701 nt, Artificial Sequence; identical to SEQ ID NO: 185353
  derived and/or modified sequence opt5 from hemagglutinin__InfluenzaA__ACI06151

SEQ ID NO: 185425 - RNA, 1701 nt, Artificial Sequence; identical to SEQ ID NO: 185353
  derived and/or modified sequence opt5 from hemagglutinin__InfluenzaA__ACI06152

SEQ ID NO: 185426 - RNA, 1701 nt, Artificial Sequence
  derived and/or modified sequence opt5 from hemagglutinin__InfluenzaA__ACI06153
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacgagcugguuauuaacagcaaugggaaccucaucgcgccucgcggauacuuuaaaaugagaacaggcaagucuuccauuaugcggagcgacgcccccaucgauaccuguauuucugaaugcaucacaccgaaugggagcaucccuaacgacaaacccuuccagaaugugaacaagauuaccuacggagcuuguccuaaauaugugaagcagaauacgcugaaacuugccacaggcaugcgcaacguccccgagaaacagaccagagggcuguuuggagcuaucgccggcuucauugaaaauggcugggaggggaugaucgauggaugguacggcuuucggcaccaaaacuccgaggggaccggacaggcggccgaccucaagucuacacaggcugccauugaucaaaucaauggcaaacugaaccgcgugaucgaaaagaccaaugagaaauuccaccagauugaaaaggaguucagcgaaguugaggggagaauccaggaccuugagaaauauguggaagauacaaagauugaccugugguccuacaacgcugagcuccuggucgcccuggaaaaucagcauacgaucgaucucaccgacagcgagaugaacaagcuguuugaaaagacacggagacaacuucgcgagaacgccgaggauaugggcaauggaugcuucaagauuuaucacaaaugugacaacgcuugcaucgaaucuauucggaauggcaccuacgaccaugauguguauagagacgaggcgcugaacaaucgcuuucagaucaaggggguugaacucaaauccggauacaaggauuggauccuguggauuagcuucgccaucucuugcuuucuucugugugugguccuccugggcuucauuaugugggcuugccagcgggggaacaucagauguaauauuugcaucuga

SEQ ID NO: 185427 - RNA, 1701 nt, Artificial Sequence
  derived and/or modified sequence opt5 from hemagglutinin__InfluenzaA__ACI06155
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauugugcggagcgacgcccccaucgauaccuguauuucugaaugcaucacaccgaauggcagcaucccuaacgacaaacccuuccagaaugucaacaagauuaccuacggggcuuguccuaaauaugugaagcagaauacgcugaaacuugccacaggaaugcgcaacguucccgagaaacagaccagaggccuguuuggggcuaucgccggauucauugaaaauggcugggagggcaugaucgaugggugguacggauuucggcaccaaaacuccgagggcaccgggcaggcggccgaccucaagucuacacaggcugccauugaucaaaucaauggaaaacugaaccgcgugaucgaaaagaccaaugagaaauuccaccagauugaaaaggaguucagcgaagucgagggcagaauccaggaccuugagaaauauguggaagauacaaagauugaccugugguccuacaacgcugagcuccugguugcccuggaaaaucagcauacgaucgaucucaccgacagcgagaugaacaagcuguuugaaaagacacggagacaacuucgcgagaacgccgaggauauggggaauggcugcuucaagauuuaucacaaaugugacaacgcuugcaucgaaucuauucggaauggaaccuacgaccaugauguguauagagacgaggcgcugaacaaucgcuuucagaucaagggcgucgaacucaaauccggguacaaggauuggauccuguggauuagcuucgccaucucuugcuuucuucugugugugguccuccugggauucauuaugugggcuugccagcggggcaacaucagauguaauauuugcaucuga

SEQ ID NO: 185428 - RNA, 1701 nt, Artificial Sequence; identical to SEQ ID NO: 185353
  derived and/or modified sequence opt5 from hemagglutinin__InfluenzaA__ACI06156

SEQ ID NO: 185429 - RNA, 1701 nt, Artificial Sequence; identical to SEQ ID NO: 185353
  derived and/or modified sequence opt5 from hemagglutinin__InfluenzaA__ACI06157

SEQ ID NO: 185430 - RNA, 1701 nt, Artificial Sequence; identical to SEQ ID NO: 185353
  derived and/or modified sequence opt5 from hemagglutinin__InfluenzaA__ACI06158

SEQ ID NO: 185431 - RNA, 1701 nt, Artificial Sequence; identical to SEQ ID NO: 185353
  derived and/or modified sequence opt5 from hemagglutinin__InfluenzaA__ACI06159

SEQ ID NO: 185432 - RNA, 1701 nt, Artificial Sequence; identical to SEQ ID NO: 185342
  derived and/or modified sequence opt5 from hemagglutinin__InfluenzaA__ACI06160

SEQ ID NO: 185433 - RNA, 1701 nt, Artificial Sequence
  derived and/or modified sequence opt5 from hemagglutinin__InfluenzaA__ACI06161
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugaaugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgagaaacagaccagaggccuguuuggggcuaucgccggauucauugaaaauggcugggagggcaugaucgaugggugguacggauuucggcaccaaaacuccgagggcaccgggcaggcggccgaccucaagucuacacaggcugccauugaucaaaucaauggaaaacugaaccgcguuaucgaaaagaccaaugagaaauuccaccagauugaaaaggaguucagcgaaguggagggcagaauccaggaccuugagaaauaugucgaagauacaaagauugaccugugguccuacaacgcugagcuccugguggcccuggaaaaucagcauacgaucgaucucaccgacagcgagaugaacaagcuguuugaaaagacacggagacaacuucgcgagaacgccgaggauauggggaauggcugcuucaagauuuaucacaaaugugacaacgcuugcaucgaaucuauucggaagggaaccuacgaccaugauguuuauagagacgaggcgcugaauaaccgcuuucagaucaaaggcguggaacucaaguccggguacaaggauuggauccuguggauuagcuucgccaucucuugcuuucuucugugugucgugcuccugggauucauuaugugggcuugccagcggggcaauaucagauguaacauuugcaucuga

SEQ ID NO: 185434 - RNA, 1701 nt, Artificial Sequence
  derived and/or modified sequence opt5 from hemagglutinin__InfluenzaA__ACI06162
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaaccccggcgacguucuggugauuaauagcaacggcaaucucaucgcgccucgcggguacuuuaagaugagaacaggaaaaucuuccauuaugcggagcgacgcccccaucgauaccuguauuucugaaugcaucacaccgaacggcagcaucccuaaugacaagcccuuccagaacgugaauaaaauuaccuacggggcuuguccuaaguaugucaaacagaacacgcugaaacuugccacaggaaugcgcaaugugcccgagaagcagaccagaggccuguuuggggcuaucgccggauucauugaaaacggcugggagggcaugaucgaugggugguacggauuucggcaccaaaauuccgagggcaccgggcaggcggccgaccucaaaucuacacaggcugccauugaucaaaucaacggaaagcugaaucgcguuaucgaaaagaccaacgagaaguuccaccagauugaaaaagaguucagcgaaguggagggcagaauccaggaccuugagaaguaugucgaagauacaaaaauugaccugugguccuacaaugcugagcuccugguggcccuggaaaaccagcauacgaucgaucucaccgacagcgagaugaacaagcuguuugaaaagacacggagacaacuucgcgagaaugccgaggauauggggaacggcugcuucaaaauuuaucacaagugugacaaugcuugcaucgaaucuauucggaacggaaccuacgaccaugauguuuauagagacgaggcgcugaauaaccgcuuucagaucaaaggcguggaacucaaguccggguacaaagauuggauccuguggauuagcuucgccaucucuugcuuucuucugugugucgugcuccugggauucauuaugugggcuugccagcggggcaauaucagauguaacauuugcaucuga

SEQ ID NO: 185435 - RNA, 1701 nt, Artificial Sequence
  derived and/or modified sequence opt5 from hemagglutinin__InfluenzaA__ACI06163
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauaugggcaauggaugcuucaagauuuaucacaaaugugacaacgcuugcaucgagucuauucggaagggcaccuacgaccaugauguuuauagagacgaagcgcugaauaaccgcuuucagaucaaagggguggagcucaaguccggauacaaggauuggauccuguggauuagcuucgccaucucuugcuuucuucugugugucgugcuccugggcuucauuaugugggcuugccagcgggggaauaucagauguaacauuugcaucuga

SEQ ID NO: 185436 - RNA, 1701 nt, Artificial Sequence
  derived and/or modified sequence opt5 from hemagglutinin__InfluenzaA__ACI06164
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuaacaucuauuggaccaucgucaagcccggcgacguucuggugauuaauuccaacgggaaucucaucgcgccucgcggauacuuuaaaaugagaaacggcaagagcucuauuaugcgguccgacgcccccaucgauacauguauuagcgagugcaucaccccgaaugggucuaucccuaacgacaaacccuuccagaaugugaacaagauuacauacggagcuuguccuaaauaugucaagcagaauacccugaaacuugccacgggcaugcgcaacgugcccgaaaagcagacaagagggcuguuuggagcuaucgccggcuucauugagaauggcugggaagggaugaucgauggaugguacggcuuucggcaccaaaacagcgaggggaccggacaggcggccgaccucaaguccacccaggcugccauugaucaaaucaauggcaaacugaaccgcguuaucgagaagacaaaugaaaaauuccaccagauugagaaggaguucucugaaguggaagggagaauccaggaccuugagaaauaugucgaggauaccaagauugaccuguggagcuacaacgcugaacuccugguggcccuggagaaccagcauacaaucgaucucacggacuccgaaaugaauaagcuguuugagaaaacccggagacaacuucgcgaaaacgccgaggauaugggcaauggaugcuucaagauuuaucacaaaugugacaacgcuugcaucgagagcauucggaauggcacauacgaccaugauguuuauagagacgaagcgcugaacaaucgcuuucagaucaaggggguggagcucaaaucuggauacaaggauuggauccuguggauuuccuucgccaucagcugcuuucuucugugugucgugcuccugggcuucauuaugugggcuugccagcgggggaacaucagauguaauauuugcaucuga

SEQ ID NO: 185437 - RNA, 1701 nt, Artificial Sequence
  derived and/or modified sequence opt5 from hemagglutinin__InfluenzaA__ACI06165
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaaauggcaagucuuccauuaugcggagcgacgcccccaucgauacauguauuucugagugcaucaccccgaacgggagcaucccuaaugacaaacccuuccagaacgugaauaagauuacauacggagcuuguccuaaauaugucaagcagaacacccugaaacuugccacgggcaugcgcaaugugcccgaaaagcagacaagagggcuguuuggagcuaucgccggcuucauugagaacggcugggaagggaugaucgauggaugguacggcuuucggcaccaaaauuccgaggggaccggacaggcggccgaccucaagucuacccaggcugccauugaucaaaucaacggcaaacugaaucgcguuaucgagaagacaaacgaaaaauuccaccagauugagaaggaguucagcgaaguggaagggagaauccaggaccuugagaaauaugucgaggauaccaagauugaccugugguccuacaaugcugaacuccugguggcccuggagaaccagcauacaaucgaucucacggacagcgaaaugaacaagcuguuugagaaaacccggagacaacuucgcgaaaaugccgaggauaugggcaacggaugcuucaagauuuaucacaaaugugacaaugcuugcaucgagucuauucggaacggcacauacgaccaugauguuuauagagacgaagcgcugaauaaccgcuuucagaucaaggggguggagcucaaauccggauacaaggauuggauccuguggauuagcuucgccaucucuugcuuucuucugugugucgugcuccugggcuucauuaugugggcuugccagcgggggaauaucagauguaacauuugcaucuga

SEQ ID NO: 185438 - RNA, 1701 nt, Artificial Sequence
  derived and/or modified sequence opt5 from hemagglutinin__InfluenzaA__ACI06166
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuuggauuagaggccugucuagccggaucaacaucuauuggaccauugugaagcccggcgacguccugguuaucaauuccaacgggaaucucauugcgccucgcggauacuuuaaaaugagaaacggcaagagcucuaucaugcgguccgacgcccccauugauacauguaucagcgagugcaucaccccgaaugggucuauuccuaacgacaaacccuuccagaaugugaacaagaucacauacggagcuuguccuaaauaugugaagcagaauacccugaaacuugccacgggcaugcgcaacguccccgaaaagcagacaagagggcuguuuggagcuauugccggcuucaucgagaauggcugggaagggaugauugauggaugguacggcuuucggcaccaaaacagcgaggggaccggacaggcggccgaccucaaguccacccaggcugccaucgaucaaaucaauggcaaacugaaccgcgugauugagaagacaaaugaaaaauuccaccagaucgagaaggaguucucugaaguugaagggcggauucaggaccuugagaaauauguggaggauaccaagaucgaccuguggagcuacaacgcugaacuccuggucgcccuggagaaccagcauacaauugaucucacggacuccgaaaugaauaagcuguuugagaaaaccagaagacaacuucgcgaaaacgccgaggauaugggcaauggaugcuucaagaucuaucacaaaugugacaacgcuugcauugagagcauccggaauggcacauacgaccaugauguguauagagacgaagcgcugaacaaucgcuuucagaucaaggggguugagcucaaaucuggauacaaggauuggauucuguggaucuccuucgccauuagcugcuuucuucugugugugguccuccugggcuucaucaugugggcuugccagcgggggaacauuagauguaauaucugcaucuga

SEQ ID NO: 185439 - RNA, 1701 nt, Artificial Sequence; identical to SEQ ID NO: 185423
  derived and/or modified sequence opt5 from hemagglutinin__InfluenzaA__ACI06167

SEQ ID NO: 185440 - RNA, 1701 nt, Artificial Sequence
  derived and/or modified sequence opt5 from hemagglutinin__InfluenzaA__ACI06168
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggugauuaacagcaaugggaaccucaucgcgccucgcggauacuuuaaaaugagaacaggcaagucuuccauuaugcggagcgacgcccccaucgauaccuguauuucugagugcaucacaccgaaugggagcaucccuaacgacaaacccuuccagaaugugaacaagauuaccuacggagcuuguccuaaauaugucaagcagaauacgcugaaacuugccacaggcaugcgcaacgugcccgaaaagcagaccagagggcuguuuggagcuaucgccggcuucauugagaauggcugggaagggaugaucgauggaugguacggcuuucggcaccaaaacuccgaggggaccggacaggcggccgaccucaagucuacacaggcugccauugaucaaaucaauggcaaacugaaccgcguuaucgagaagaccaaugaaaaauuccaccagauugagaaggaguucagcgaaguggaagggagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggaagcaacuuagagaaaacgccgaggauaugggcaauggaugcuucaaaauuuaucacaagugugacaacgcuugcaucgagucuauucgcaauggcaccuacgaccaugauguuuaucgggacgaagcgcugaacaauagauuucagaucaaagggguggagcucaaguccggauacaaggauuggauccuguggauuagcuucgccaucucuugcuuucuucugugugucgugcuccugggcuucauuaugugggcuugccagcgcgggaacauccgguguaauauuugcaucuga

SEQ ID NO: 185441 - RNA, 1701 nt, Artificial Sequence; identical to SEQ ID NO: 185342
  derived and/or modified sequence opt5 from hemagglutinin__InfluenzaA__ACI06169

SEQ ID NO: 185442 - RNA, 1701 nt, Artificial Sequence; identical to SEQ ID NO: 185359
  derived and/or modified sequence opt5 from hemagglutinin__InfluenzaA__ACI06171

SEQ ID NO: 185443 - RNA, 1701 nt, Artificial Sequence; identical to SEQ ID NO: 185359
  derived and/or modified sequence opt5 from hemagglutinin__InfluenzaA__ACI06172

SEQ ID NO: 185444 - RNA, 1701 nt, Artificial Sequence
  derived and/or modified sequence opt5 from hemagglutinin__InfluenzaA__ACI06173
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucggaucccgcccuugggugagaggccugucuagccggauuuccaucuauuggaccaucgucaagcccggcgacguucuggagauuaacagcaaugggaaccucaucgcgccucgcggauacuuuaaaaugagaacaggcaagucuuccauuaugcggagcgacgcccccaucgauaccuguauuucugaaugcaucacaccgaaugggagcaucccuaacgacaaacccuuccagaaugugaacaagauuaccuacggagcuuguccuaaauaugugaagcagaauacgcugaaacuugccacaggcaugcgcaacguccccgagaaacagaccagagggcuguuuggagcuaucgccggcuucauugaaaauggcugggaggggaugaucgauggaugguacggcuuucggcaccaaaacuccgaggggaccggacaggcggccgaccucaagucuacacaggcugccauugaucaaaucaauggcaaacugaaccgcgugaucgaaaagaccaaugagaaauuccaccagauugaaaaggaguucagcgaaguugaggggagaauccaggaccuugagaaauauguggaagauacaaagauugaccugugguccuacaacgcugagcuccuggucgcccuggaaaaucagcauacgaucgaucucaccgacagcgagaugaacaagcuguuugaaaagacacggagacaacuucgcgagaacgccgaggauaugggcaauggaugcuucaagauuuaucacaaaugugacaacgcuugcaucgaaucuauucggaauggcaccuacgaccaugauguguauagagacgaggcgcugaacaaucgcuuucagaucaaggggguugaacucaaauccggauacaaggauuggauccuguggauuagcuucgccaucucuugcuuucuucugugugugguccuccugggcuucauuaugugggcuugccagcgggggaacaucagauguaauauuugcaucuga

SEQ ID NO: 185445 - RNA, 1701 nt, Artificial Sequence; identical to SEQ ID NO: 185359
  derived and/or modified sequence opt5 from hemagglutinin__InfluenzaA__ACI06174

SEQ ID NO: 185446 - RNA, 1701 nt, Artificial Sequence; identical to SEQ ID NO: 185360
  derived and/or modified sequence opt5 from hemagglutinin__InfluenzaA__ACI06175

SEQ ID NO: 185447 - RNA, 1701 nt, Artificial Sequence; identical to SEQ ID NO: 185360
  derived and/or modified sequence opt5 from hemagglutinin__InfluenzaA__ACI06176

SEQ ID NO: 185448 - RNA, 1701 nt, Artificial Sequence; identical to SEQ ID NO: 185360
  derived and/or modified sequence opt5 from hemagglutinin__InfluenzaA__ACI06177

SEQ ID NO: 185449 - RNA, 1689 nt, Artificial Sequence
  derived and/or modified sequence opt5 from hemagglutinin__InfluenzaA__ACI25724
auggccaucauuuaccugauccuccuguucgcuaccgugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccauugcuggauggcuccugggcaauccggagugugaccgccugcucagagugcccgaauggucuuacaucauggagcgggagaacccucgcuauagccugugcuaccccgggucccuuaaugauuaugaggaacugaaacaucuccugucuagcgucaagcacuuugaaaaggugagaauccuuccuaaagaccgguggacacaacauaccacaaccggaggcuccaaggccugugccguuucuggcaaacccagcuucuuucgcaacaugguguggcugacgaagaaagggccuaauuacccggucgcuaagggauccuauaacaauaccagcggcgagcagaugcucaucauuuggggagugcaccaccccaaggaugaggccgaacagagagcucuguaccaggagguugggacauacgugucugccuccaccagcacacugaacaaacggucuaucccugaaauugcggcccgccccgaggucaauggccucggguccagaauggaguucagcuggacccugcuugacgugugggauacgaucaacuuugaaucuacaggaaaucugguggcuccugaguauggcuucaagaucuccaaacggggcagcuccgggauuaugaagaccgaaggaacacucggcaacugcgagaccaaaugucaaacaccccugggggccaucaacaccacgcuuccguuucauaauguccacccucugaccauuggagaaugccccaaguacguuaaaucugagaagcucgugcuggcuacaggccugcgcaacgugccucagaucgaaagcagaggacucuucggggccauugcgggcuuuaucgagggcggguggcagggaauggucgacggcugguauggguaccaucacuccaaugaucagggaagcggcuaugccgcugacaaggagucuacccaaaaagccuucgaugggaucacaaacaagguuaauuccgugauugagaaaaugaacacccaguuugaagcugugggcaaggaguucaauaaccuggaaaaacggcuugaaaaucugaacaagaagauggaggacggauuucucgacgucuggacguacaaugccgagcugcuugugcugauggaaaacgagcgcacacucgauuuccacgacagcaauguuaaaaaccuguaugaaaaggugagaaugcagcugcgggauaaugucaaagagcucggcaacggguguuucgaguuuuaccauaagugcgacgaugaauguaugaacucugugaaaaauggaaccuacgacuaucccaaguacgaggaagagagcaagcugaaaagaaacgaaaucaagggcgucaaacuuuccucuauggggguguaucagauucuggccaucuacgcuaccguugcgggaagccucucccuggccauuaugguggcuggcaucagcuucuggaugugcucuaaugggucccugcaaugccgcaucuguauuuga

SEQ ID NO: 185450 - RNA, 1701 nt, Artificial Sequence
  derived and/or modified sequence opt5 from hemagglutinin__InfluenzaA__ACI25746
augaagaccaucauugcccugagcuacaucuucugccucgcucugggccaguaucuucccgggaacgacaauuccacagccacgcugugucucggacaccaugcggugccuaacggcacccuggucaaaacaauuaccgaugaccaaaucgagguuacaaaugcuaccgaacuugugcagucuagcuccacagggaagauuugcaacaauccgcacagaauccuggauggaaucgacuguacccucauugaugcccugcugggcgacccccauugcgauguguuucagaacgagacgugggaccucuucgucgaacggucuaaagccuuuagcaauuguuacccuuaugaugugcccgacuacgcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaucccguccuuaaugugaccaugccuaacaaugauaacuucgacaagcuguacauuuggggcguucaccauccguccacaaaucaagagcagaccagccucuaugugcaggccucugggcgcgucaccguguccacaagacggagccagcaaacgaucauucccaacaucggaucccgcccuugggugagaggccugucuagccggauuuccaucuacuggaccaucgucaagcccggcgauguucuggugauugacagcaacgggaaucucaucgcgccucgcggauacuuuaaaaugagaacaggcaagucuuccauuaugcggagcgacgcccccaucgauaccuguauuucugagugcaucacaccgaacgggagcaucccuaaugacaaacccuuccagaacgugaauaagauuaccuauggagcuuguccuaaauacgucaagcagaacacgcugaaacuugccacaggcaugcgcaaugugcccgaaaagcagaccagagggcuguuuggagcuaucgccggcuucauugagaacggcugggaagggaugaucgauggaugguauggcuuucggcaccaaaauuccgaggggaccggacaggcggccgaccucaagucuacacaggcugccauugaucaaaucaacggcaaacugaaucgcguuaucgagaagaccaacgaaaaauuccaccagauugagaaggaguucagcgaaguggaagggagaauccaggaccuugagaaauacgucgaggauacaaagauugaccugugguccuauaaugcugaacuccugguggcccuggagaaccagcauacgaucgaucucaccgacagcgaaaugaauaagcuguuugagaaaacacggagacaacuucgcgaaaacgccgaggauaugggcaacggaugcuucaagauuuaccacaaaugugacaaugcuugcaucgagucuauucggaacggcaccuaugaccaugauguuuacagagacgaagcgcugaauaaccgcuuucagaucaaggggguggagcucaaauccggauacaaggauuggauccuguggauuagcuucgccaucucuugcuuucuucugugugucgugcuccugggcuucauuaugugggcuugccagcgggggaauaucagauguaacauuugcaucuga

SEQ ID NO: 185451 - RNA, 1701 nt, Artificial Sequence
  derived and/or modified sequence opt5 from hemagglutinin__InfluenzaA__ACI25757
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccuuguccugaaugugaccaugcccaacaaugacaacuucgauaagcucuauauuuggggcguucaccauccuuccacaaaucaagagcagaccagccuguacgugcaggccucugggcgcgucaccguguccacaagacggagccagcaaacgaucauuccgaacaucggaucccgccccugggugagaggccugucuagccggauuuccaucuauuggaccaucgucaagccuggcgacguucucgugauuaacagcaaugggaaccugaucgcgccccgcggauacuuuaaaaugagaacaggcaagucuuccauuaugcggagcgacgccccuaucgauaccuguauuucugagugcaucacacccaaugggagcaucccgaacgacaaaccuuuccagaaugugaacaagauuaccuacggagcuugucccaaauaugucaagcagaauacgcuuaagcuggccacaggcaugcgcaacgugccugaaaaacagaccagagggcucuuuggagcuaucgccggcuucauugagaauggcugggaagggaugaucgauggaugguacggcuuucggcaccaaaacuccgaggggaccggacaggcggccgaccugaagucuacacaggcugccauugaucaaaucaauggcaaacuuaaccgcguuaucgagaagaccaaugaaaaauuccaccagauugagaaggaguucagcgaaguggaagggagaauccaggaccuggagaaauaugucgaggauacaaagauugaccucugguccuacaacgcugaacugcugguggcccucgagaaucagcauacgaucgaucugaccgacagcgaaaugaacaaacuuuuugagaagacacggagacaacugcgcgaaaacgccgaggauaugggcaauggaugcuucaagauuuaucacaaaugugacaacgcuugcaucgagucuauucggaauggcaccuacaaccaugacguuuauagagaugaagcgcucaauaaccgcuuucagaucaaggggguggagcugaaauccggauacaaggacuggauccuuuggauuagcuucgccaucucuugcuuucugcucugugucgugcugcugggcuucauuaugugggcuugccagcgggggaauaucagauguaacauuugcaucuga

SEQ ID NO: 185452 - RNA, 1701 nt, Artificial Sequence; identical to SEQ ID NO: 185340
  derived and/or modified sequence opt5 from hemagglutinin__InfluenzaA__ACI25768

SEQ ID NO: 185453 - RNA, 1701 nt, Artificial Sequence
  derived and/or modified sequence opt5 from hemagglutinin__InfluenzaA__ACI25779
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucuggucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugagugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgaaaagcagaccagaggccuguuuggggcuaucgccggauucauugagaauggcugggaaggcaugaucgaugggugguacggauuucggcaccaaaacuccgagggcaccgggcaggcggccgaccucaagucuacacaggcugccauugaucaaaucaauggaaaacugaaccgcguuaucgagaagaccaaugaaaaauuccaccagauugagaaggaguucagcgaaguggaaggcagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauauggggaauggcugcuucaagauuuaucacaaaugugacaacgcuugcaucgagucuauucggaauggaaccuacgaccaugauguuuauagagacgaagcgcugaacaaucgcuuucagaucaagggcguggagcucaaauccggguacaaggauuggauccuguggauuagcuucgccaucucuugcuuucuucugugugucgugcuccugggauucauuaugugggcuugccagcggggcaacaucagauguaauauuugcaucuga

SEQ ID NO: 185454 - RNA, 1701 nt, Artificial Sequence
  derived and/or modified sequence opt5 from hemagglutinin__InfluenzaA__ACI25790
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucuggucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugagugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgaaaagcagaccagaggccuguuuggggcuaucgccggauucauugagaauggcugggaaggcaugaucgaugggugguacggauuucggcaccaaaacuccgagggcaccgggcaggcggccgaccucaagucuacacaggcugccauugaucaaaucaauggaaaacugaaccgcguuaucgagaagaccaaugaaaaauuccaccagauugagaaggaguucagcgaaguggaaggcagaauccaggaccuugagaaauaugucgaggauacaaagauugaccugugguccuacaacgcugaacuccugguggcccuggagaaucagcauacgaucgaucucaccgacagcgaaaugaacaagcuguuugagaaaacacggagacaacuucgcgaaaacgccgaggauauggggaauggcugcuucaagauuuaucacaaaugugacaacgcuugcaucgagucuauucgguccggaaccuacgaccaugauguuuauagagacgaagcgcugaauaaccgcuuucagaucaagggcguggagcucaaaagcggguacaaggauuggauccuguggauuucuuucgccaucuccugcuuucuucugugugucgugcuccugggauucauuaugugggcuugccagcggggcaauaucagauguaacauuugcaucuga

SEQ ID NO: 185455 - RNA, 1701 nt, Artificial Sequence
  derived and/or modified sequence opt5 from hemagglutinin__InfluenzaA__ACI25801
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucaacuguacccucauugaugcccugcugggcgacccccauugcgauguguuucagaaugagacgugggaccucuucgucgaacggucuaaagccuuuagcaacuguuauccuuacgaugugcccgacuaugcuucccugcgcucucuuguugccagcuccgggacccuggaguucaucacagaagauuuuaccuggacaggagugacccagaauggcggcagcaacgcuugcaagagagggccuggaucuggcuucuuuucccggcucaauuggcugacgaaaagcgggucuacauaccccguccuugacgugaccaugccuaacaaugauaacuucgacaagcuguauauuuggggaguucaccauccguccacaaaucaagagcagaccagccucuacgugcaggccucuggccgcgucaccguguccacaagacggagccagcaaacgaucauucccaacaucgggucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgaugcccccaucgacaccuguauuucugagugcaucacaccgaauggcagcaucccuaacgauaaacccuuccagaaugugaacaagauuaccuacggggcuuguccuaaauaugucaagcagaauacgcugaaacuugccacaggaaugcgcaacgugcccgaaaagcagaccagaggccuguuuggggcuaucgccggauucauugagaauggcugggaaggcaugaucgacgggugguacggauuucggcaccaaaacuccgagggcaccgggcaggcggccgaucucaagucuacacaggcugccauugaccaaaucaauggaaaacugaaccgcguuaucgagaagaccaaugaaaaauuccaccagauugagaaggaguucagcgaaguggaaggcagaauccaggaucuugagaaauaugucgaggacacaaagauugaucugugguccuacaacgcugaacuccugguggcccuggagaaucagcauacgaucgaccucaccgauagcgaaaugaacaagcuguuugagaaaacacggagacaacuucgcgaaaacgccgaggacauggggaauggcugcuucaagauuuaucacaaaugugacaacgcuugcaucgagucuauucggaauggaaccuacgaucaugacguuuauagagaugaagcgcugaacaaucgcuuucagaucaagggcguggagcucaaauccggguacaaggacuggauccuguggauuagcuucgccaucucuugcuuucuucugugugucgugcuccugggauucauuaugugggcuugccagcggggcaacaucagauguaauauuugcaucuga

SEQ ID NO: 185456 - RNA, 1689 nt, Artificial Sequence; identical to SEQ ID NO: 185374
  derived and/or modified sequence opt5 from hemagglutinin__InfluenzaA__ACI26274

SEQ ID NO: 185457 - RNA, 1698 nt, Artificial Sequence
  derived and/or modified sequence opt5 from hemagglutinin__InfluenzaA__ACI26307
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccuguuacagauaaugaccagaucuuucucuaugcccagucugggcgcauuaccguguccacaaaaagaagccaacagaccgucaucccgaacauuggaucccggccccgcgugagaaauucuccuagccggaucuccaucuacuggaccauugugaagcccggcgauauccugcugauuaacagcacagggaaucucaucgcgccucgcggauacuucaaaauuagaucuggcaaguccagcaucaugcggucugacgcccccaucgggaaguguaacagcgaaugcauuacgccgaauggauccaucccuaacgacaaacccuuucagaaugucaaccgcauuaccuauggcgcuuguccuagauacguuaagcagaauacacugaaacuugccaccggcaugcggaacgugcccgagaagcaaacacgcgggaucuucggagcuauugccggcuuuaucgaaaaugggugggagggaaugguggauggcugguauggguucagacaccagaacucugagggaaucggccaggcggccgaccugaaaagcacccaagcugccauugaucagaucaauggcaagcucaaccggcugauugggaaaacgaacgaaaaguuccaccagaucgagaaggaauuuuccgaggucgaaggacgcauucaggaccuugagaaauacguggaggauacaaagaucgaccuguggagcuauaaugcugaacuccugguugcccuggagaaccaacauaccauugaucucaccgacucugaaaugaauaaacuguucgagaagaccaaaaagcagcuuagagaaaacgccgaggauaugggcaaugggugcuuuaagaucuaccacaaaugugacaacgcuugcaucggauccauucggaauggcacauaugaucaugacguguacagagacgaggcgcugaacaaucgcuuccagaucaagggggucgaacucaaaagcggcuacaaggauuggauucuguggaucucuuuugccauuuccugcuuccuucuguguguggcucuccugggauuuaucaugugggccugccagaaaggcaacauccgguguaauauuugcaucuga

SEQ ID NO: 185458 - RNA, 1701 nt, Artificial Sequence
  derived and/or modified sequence opt5 from hemagglutinin__InfluenzaA__ACI26362
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccagaucaaaggcguggaacucaaguccggauacaaagauuggauucuguggaucagcuuugccauuucuugcuuccuucugugugucgcccuccugggcuuuaucaugugggcuugccaaaaggggaacaucagauguaauauuugcaucuga

SEQ ID NO: 185459 - RNA, 1701 nt, Artificial Sequence
  derived and/or modified sequence opt5 from hemagglutinin__InfluenzaA__ACI26373
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacugggcuggagugacccagaauggcacauccagcgccugcauccgcaagucuaacaauuccuuuuucagcagacugaacuggcucacccaucugaaguuuaaauauccugcgcuuaaugucacaaugcccaacaacgagcaguucgacaagcuguacauuuggggcgugcaccauccugggaccgauaaugaccagaucuuucucuaugcccaggcuucuggacggauuacgguuuccacaaaacgcagccaacagaccgugaucccgaacauuggcuccagaccccggguccgcaauaucccuucuagaaucagcauuuacuggacaaucgugaagcccggggauauucugcugaucaacuccaccggaaaucucauugccccucggggcuacuucaaaauccgcagcgggaagucuuccaucaugagaagcgacgcucccauuggaaaguguaacucugaaugcaucaccccgaauggcagcauuccuaacgacaaacccuuucagaaugugaaccggaucacauauggcgccuguccucgcuacgucaagcaaaauacgcugaaacuugcgaccgggaugagaaacguucccgagaagcagacacggggaauuuucggcgccaucgcuggguuuaucgaaaauggaugggagggcaugguggaugggugguauggauuccgccaccagaacuccgagggcagaggccaagccgcugaccugaaaucuacccaggccgccauugaucagaucaaugggaagcucaaccggcugauuggaaaaacaaacgaaaaguuccaccagaucgagaaggaauuuagcgagguggaaggccgcauucaagaccuugagaaauacgucgaggauaccaagaucgaccugugguccuauaaugcugaacuccugguggcgcuggagaaccagcauacgauugaucucacagacagcgaaaugaauaaacuguucgagaagaccaaaaagcagcuuagagaaaacgccgaggauauggggaauggaugcuuuaagaucuaccacaaaugugacaacgcuugcaucggcucuauucggaaugggaccuaugaucaugacguuuacagagacgaggcccugaacaaucgcuuccagaucaagggcguggaacucaaauccggauacaaggauuggauucuguggaucagcuuugccauuucuugcuuccuucugugugucgcucuccugggcuuuaucaugugggccugccaaaaagggaacauccgguguaauauuugcaucuga

SEQ ID NO: 185460 - RNA, 1701 nt, Artificial Sequence; identical to SEQ ID NO: 185325
  derived and/or modified sequence opt5 from hemagglutinin__InfluenzaA__ACI26395

SEQ ID NO: 185461 - RNA, 1701 nt, Artificial Sequence
  derived and/or modified sequence opt5 from hemagglutinin__InfluenzaA__ACI26406
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaagcacccugcccuuaaugucaccaugcccaacaacgagaaauucgacaagcuguauauuuggggcgugcaucacccugggacggauaaugaccagaucuuucucuacgcgcaggccucuggacgcauuacaguuuccaccaaaagaagccaacagacagugaucccgaacauuggcucccggccccgcgucagaaauaucccuucucggaucagcauuuauuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguacggcgcuuguccuagauaugucaagcagaauacccugaaacuugccacagggaugcggaacguucccgagaagcaaacccgcggaauuuucggcgcgaucgccggguuuaucgaaaauggaugggagggcaugguggaugggugguacggauucagacaccagaacuccgagggcauuggccaggcugccgaccugaaaucuacacaagcugccaucgaucagauuaaugggaagcucaaccggcugaucggaaaaaccaacgaaaaguuccaucagauugagaaggaauuuagcgagguggaaggcagaauccaggaccuugagaaauaugucgaggauacgaagauugaccugugguccuacaaugccgaacuccugguggcucuggagaaccaacacacaaucgaucucaccgacagcgaaaugaauaaacuguucgagaagaccaaaaagcagcuucgcgaaaacgcggaggauauggggaauggaugcuuuaagaucuaucauaaaugugacaacgccugcauuggcucuauccggaaugggacauacgaucacgacguuuauagagacgaggcucugaacaaucgcuuccagauuaagggcguggaacucaaauccggauacaaggauuggauccuguggauuagcuuugccaucucuugcuuccuucugugugucgcccuccugggcuuuaucaugugggcuugccagaaagggaacauucgguguaauaucugcauuuga

SEQ ID NO: 185462 - RNA, 1701 nt, Artificial Sequence; identical to SEQ ID NO: 184952
  derived and/or modified sequence opt5 from hemagglutinin__InfluenzaA__ACI26417

SEQ ID NO: 185463 - RNA, 1701 nt, Artificial Sequence
  derived and/or modified sequence opt5 from hemagglutinin__InfluenzaA__ACI26428
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagaucucuagcacaggcgggaucugcgacuccccgcaccagauucuugauggagagaauuguacccugaucgacgcccuccugggcgauccccagugcgacggguuucaaaacaaaaagugggaucuguucgucgaaagaucuaaagccuauagcaauuguuacccuuaugacgugcccgauuacgcuucccuccggucucugguugccagcuccggaacgcuugaguuuaacaaugagagcuucaacuggaccggcgugacacagaauggcaccucuuccagcugcaagcgcagaucuaacaauuccuuuuucagccggcugaacuggcucacacaucugaaguuuaaauauccugcucuuaaugucaccaugcccaacaacgaaaaguucgacaaacuguacauuuggggagugcaccauccuguuacggauaaugaccagauccgccucuaugcccaggcgucugggagaauuacaguguccaccaagcggagccaacagacagucaucccgaacauuggcuaccgccccagagugcgggauaucccuucccgcaucucuauuuacuggaccaucgugaaacccggggacauucugcugaucaauagcaccggaaaccucauugccccuagaggcuauuuuaagauccgguccggaaagagcucuaucaugcgcuccgacgcucccauugggaaauguaauagcgagugcaucacaccgaacggcucuauuccuaaugauaagcccuuccagaacgucaauagaaucacguacggcgccuguccucgguauguuaaacagaacacccugaaacuugcuacagggaugcgcaaugugcccgaaaagcaaaccagaggaauuuuuggcgccaucgcgggguucaucgagaacggaugggaaggcaugguggacgggugguacggauuucggcaccagaauagcgagggcauuggccaggccgcugaucugaaguccacacaagccgcuaucaaccagauuaaugggaaacucaacagacugaucggaaagaccaacgagaaguuccaccagauugaaaaagaguucucugaagucgagggccgcauccaggaccuugaaaaguauguggaggauacgaaaauugaccuguggagcuacaaugccgagcuccugguugcccuggaaaaccaacauacaaucgaucucaccgacuccgagaugaauaagcuguuugaacggaccaaaaagcagcuuagagagaacgcugaagauauggggaauggaugcuucaagaucuaucacaaaugugacaacgcgugcauuggcagcauccgcaaugggacauacgaucaugacguguaccgggacgaggcccugaacaauagauuucagauuaagggcgucgagcucaaaucuggauauaaggauuggauccuguggauuuccuucgcuaucagcugcuuucuucugugugugguucuccugggcuucaucaugugggccugccagaaagggaacauucgcuguaauaucugcauuuga

SEQ ID NO: 185464 - RNA, 1698 nt, Artificial Sequence
  derived and/or modified sequence opt5 from hemagglutinin__InfluenzaA__ACI26439
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcaaccagcgcgcccuguaccauaccgaaaaugcuuacgugagcgucguuuccucucacuauagcagaaaguucacacccgagauugccaaacggccuaaggugcgcgaucaggaagggagaaucaacuacuauuggacccuucuggagcccggagacacgauuaucuuugaggcgaauggcaaccucauugccccucgguacgcuuucgcccugucccgcggguuuggaagcggcaucauuaauucuaacgcucccauggaugaaugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugaugucuggacauacaacgcggagcugcuugugcugcucgaaaaugagagaacccuggacuuucaugacagcaacgucaagaaucuuuaugaaaaagugaagucucagcugaagaacaaugccaaagagaucggcaacgggugcuucgaguuuuaccacaaguguaaugaugaaugcauggaguccguuaaaaacggcacauaugacuaccccaaguauagcgaagagucuaaacucucccgggagaagauugauggagugaagcuggaaagcaugggcgucuaccagauccuggcuauuuauuccaccguggccucuagccucguucugcuugugucccugggggccaucucuuucuggaugugcagcaauggaucccuccagugucgcaucugcauuuga

SEQ ID NO: 185465 - RNA, 1698 nt, Artificial Sequence; identical to SEQ ID NO: 185464
  derived and/or modified sequence opt5 from hemagglutinin__InfluenzaA__ACI26450

SEQ ID NO: 185466 - RNA, 1701 nt, Artificial Sequence
  derived and/or modified sequence opt5 from hemagglutinin__InfluenzaA__ACI26461
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccugggacagauaaugaccagaucuuuccguaugcccaggcgucuggacgcauuaccguuuccacaaaaagaagccaacagaccgugauccccaacauuggcucccggccucgcgucagaaauauccccucucggaucagcauuuacuggaccaucgugaagccuggggauauucuccugaucaacuccacaggaaaucugauugcuccccgcggcuacuucaaaaucagaagcgggaagucuuccaucaugcggagcgacgccccgauuggaaaguguaacucugaaugcaucacgccuaauggcagcauucccaacgacaaaccuuuucagaaugugaaccgcaucaccuauggcgccugucccagauacgucaagcagaauacacucaaacuggcuaccgggaugcggaacguucccgagaagcaaacacgcggaauuuucggcgccaucgcgggguuuaucgaaaauggaugggagggcaugguggaugggugguauggauucagacaccagaacuccgagggcauuggccaggccgcugaccuuaaaucuacccaagccgcuaucgaucagauuaaugggaagcugaaccggcucaucggaaaaacgaacgaaaaguuccaccagauugagaaggaauuuagcgagguggaaggcagaauccaggaccuggagaaauacgucgaggauacaaagauugaccuuugguccuauaaugccgaacugcucguggcccuggagaaccaacauaccaucgaucugaccgacagcgaaaugaauaaacucuucgagaagaccaaaaagcagcugcgcgaaaacgcugaggauauggggaauggaugcuuuaagaucuaccacaaaugugacaacgcgugcauuggcucuauccggaaugggacauaugaucauaacguuuacagagacgaggcccuuaauaaccgcuuccagauuaagggcguggaacugaaauccggauacaaggacuggauccucuggauuagcuuugcuaucucuugcuuccugcuuugugucgcccugcucggcuuuaucaugugggccugccagaaagggaauauucgguguaacaucugcauuuga

SEQ ID NO: 185467 - RNA, 1698 nt, Artificial Sequence
  derived and/or modified sequence opt5 from hemagglutinin__InfluenzaA__ACI26472
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccuguuacagauaaugaccagaucuuucucuaugcccagucugggcgcauuaccguguccacaaaaagaagccaacagaccgucaucccgaacauuggauaccggccccgcgugagaaauaucccuucccggaucucuauuuacuggaccaucgugaagcccggcgauauucugcugaucaacagcacagggaaucucauugcgccucgcggauauuucaaaaucagauccggcaagagcucuaucaugcgguccgacgcccccauugggaaguguaacagcgaaugcaucacgccgaauggaucuauuccuaacgacaaacccuuucagaaugucaaccgcaucaccuacggcgcuuguccuagauauguuaagcagaauacacugaaacuugccaccggcaugcggaacgugcccgagaagcaaacacgcgggauuuucggagcuaucgccggcuuuaucgaaaaugggugggagggaaugguggauggcugguacggguucagacaccagaacagcgagggaauuggccaggcggccgaccugaaauccacccaagcugccaucgaucagauuaauggcaagcucaaccggcugaucgggaaaacgaacgaaaaguuccaccagauugagaaggaauuuucugaggucgaaggaagaauccaggaccuugagaaauauguggaggauacaaagauugaccuguggagcuacaaugcugaacuccugguugcccuggagaaccaacauaccaucgaucucaccgacuccgaaaugaauaaacuguucgagaagaccaaaaagcagcuucgcgaaaacgccgaggauaugggcaaugggugcuuuaagaucuaucacaaaugugacaacgcuugcauuggaagcauccggaauggcacauacgaucaugacguguacagagacgaggcgcugaacaaucgcuuccagauuaagggggucgaacucaaaucuggcuauaaggauuggauccuguggauuuccuuugccaucagcugcuuccuucuguguguggcucuccugggauuuaucaugugggccugccagaaaggcaacauucgguguaauaucugcauuuga

SEQ ID NO: 185468 - RNA, 1701 nt, Artificial Sequence; identical to SEQ ID NO: 185459
  derived and/or modified sequence opt5 from hemagglutinin__InfluenzaA__ACI26483

SEQ ID NO: 185469 - RNA, 1701 nt, Artificial Sequence
  derived and/or modified sequence opt5 from hemagglutinin__InfluenzaA__ACI26505
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacugggcuggagugacccagaauggcacauccagcgccugcauccgcaagucuaacaauuccuuuuucagcagacugaacuggcucacccaucugaaguuuaaauauccugcgcuuaaugucacaaugcccaacaacgagcaguucgacaagcuguacauuuggggcgugcaccauccugggaccgauaaugaccagaucuuucucuaugcccaggcuucuggacggauuacgguuuccacaaaacgcagccaacagaccgugaucccgaacauuggcuccagaccccggguccgcaauaucccuucuagaaucagcauuuacuggacaaucgugaagcccggggauauucugcugaucaacuccaccggaaaucucauugccccucggggcuacuucaaaauccgcagcgggaagucuuccaucaugagaagcgacgcucccauuggaaaguguaacucugaaugcaucaccccgaauggcagcauuccuaacgacaaacccuuucagaaugugaaccggaucacauauggcgccuguccucgcuacgucaagcaaaauacgcugaaacuugcgaccgggaugagaaacguucccgagaagcagacacggggaauuuucggcgccaucgcuggguuuaucgaaaauggaugggagggcaugguggaugggugguauggauuccgccaccagaacuccgagggcagaggccaagccgcugaccugaaaucuacccaggccgccauugaucagaucaaugggaagcucaaccggcugauuggaaaaacaaacgaaaaguuccaccagaucgagaaggaauuuagcgagguggaaggccgcauucaagaccuugagaaauacgucgaggauaccaagaucgaccugugguccuauaaugcugaacuccugguggcgcuggagaaccagcauacgauugaucucacagacagcgaaaugaauaaacuguucgagaagaccaaaaagcagcuuagagaaaacgccgaggauauggggaauggaugcuuuaagaucuaccacaaaugugacaacgcuugcauccggucuauuagaaauggcaccuaugaucaugacguuuaccgcgacgaggcccugaacaaucgguuccagaucaaggggguggaacucaaauccggcuacaaggauuggauucuguggaucagcuuugccauuucuugcuuccuucugugugucgcucuccugggauuuaucaugugggccugccaaaaaggcaacaucagauguaauauuugcaucuga

SEQ ID NO: 185470 - RNA, 1701 nt, Artificial Sequence; identical to SEQ ID NO: 185458
  derived and/or modified sequence opt5 from hemagglutinin__InfluenzaA__ACI26516

SEQ ID NO: 185471 - RNA, 1701 nt, Artificial Sequence; identical to SEQ ID NO: 185459
  derived and/or modified sequence opt5 from hemagglutinin__InfluenzaA__ACI26527

SEQ ID NO: 185472 - RNA, 1701 nt, Artificial Sequence
  derived and/or modified sequence opt5 from hemagglutinin__InfluenzaA__ACI26538
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgauaaacagacccgcggaauuuucggcgcgaucgccggguuuaucgagaauggaugggaaggcaugguggacgggugguauggauucagacaccagaacuccgagggccggggccaagcugccgaucugaagucuacacaggcugccauugaccagaucaaugggaaacucaacagacugauuggaaagaccaacgagaaauuccaccagaucgaaaaggaguuuagcgaaguggagggccgcauucaagaucuugaaaaguacgucgaggacacgaaaaucgaucugugguccuauaaugccgagcuccugguggcucuggaaaaccagcauacaauugaccucaccgauagcgagaugaauaagcuguucgaaaagaccaagaaacagcuucgggagaacgcggaagacauggggaauggaugcuuuaagaucuaccacaagugugauaacgccugcaucggcucuauuagaaaugggacauaugaccaugacguuuaccgcgaugaggcucugaacaaucgguuccagaucaaaggcguggagcucaaguccggauacaaagacuggauucuguggaucagcuuugccauuucuugcuuccuucugugugucgcccuccugggcuuuaucaugugggcuugccaaaaggggaacaucagauguaauauuugcaucuga

SEQ ID NO: 185473 - RNA, 1701 nt, Artificial Sequence
  derived and/or modified sequence opt5 from hemagglutinin__InfluenzaA__ACI26549
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacgagaagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggagugacacagucuggcggcuccuauagcugcaagcgggggucugucaacuccuucuuuagccgccugaauuggcuccacgagucugaguacaaguauccugcucugaacgugaccaugcccaauaacggaaaauucgauaagcuguacaucuggggcguucaucacccuuccacagacagagaacaaaccaaacuguacgugcgggccagcgggcgcgucacgguguccacaaagagaucucagcagaccgugauuccgaauaucggaagccggcccuggguccgcggccucuccagcagaauuucuaucuauuggacaauuguuaaaccuggggauauccugcugaucaacuccaccggaaaccucauugcgccccggggcuacuuuaagauccgcaccggcaagagcucuauuaugagaagcgacgccccuaucgggacauguuccucugagugcauuacgcccaauggaagcaucccgaacgacaaaccuuuccagaaugugaacaagaucaccuauggcgcuuguccccgguacgugaaacaaaauacacugaaacuugccaccgggaugcgcaacgucccugaaaagcagacaagaggaauuuuuggcgcuaucgccggguucauugagaauggaugggagggcaugguggauggcugguauggguuucggcaccagaacuccgaaggaaccggccaggcggccgaccuuaagagcacgcaagcugccaucgaucagauuaaugggaaacucaacagacugaucgagaagacaaaugaaaaguuccaucagaucgagaaagaguucucugaaguugagggacgcauucaagaccuugaagaguacguggaagauaccaagaucgaccugugguccuauaacgcugagcuccuggucgcccuggaaaaucagcacaccauugaucucacagacagcgagaugaacaaacuguuugagaagacccggaaacagcuuagagaaaaugccgaggauaugggcaacgggugcuucaagaucuaccauaagugugacaacgcuugcauuggcucuauccgcaauggaacauacgaucacgacguguaucgggacgaagcgcugaacaauagauuucagauuaaaggcguugagcucaaguccggguacaaagauuggauccuguggaucagcuucgccauuuccugcuuucuucugugugugguccuccugggauucaucaugugggcuugccaaaagggcaacauucgcuguaauaucugcauuuga

SEQ ID NO: 185474 - RNA, 1701 nt, Artificial Sequence
  derived and/or modified sequence opt5 from hemagglutinin__InfluenzaA__ACI26560
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaagcuguacaucuggggcguucaucacccuauuaccgacagagaacaaacaaaucuguacgugcgggccucugggcgcgucaccguguccacgaaaagaagccagcagacagugaucccgaacauuggaucccggcccuggguccgcggccucucuagcagaaucuccauuuauuggaccaucguuaagccuggggauauccugcugauuaacagcacaggaaaucucaucgcuccccggggcuacuuuaaaauucgcaccggcaagucuuccaucaugagaagcgacgccccuauugggaccuguucuagcgagugcaucacacccaacggauccaucccgaaugacaagccuuuccagaacgugaaucggauuacguauggcgcuuguccccgcuacgugaaacaaaacacccugaaacuugccacagggaugagaaaugucccugaaaagcagacccggggaaucuuuggcgcgauugccggguucaucgagaacggaugggagggcaugguggauggcugguauggguuuagacaccaaaauucugaaggaacaggccaggcugccgaccuuaagagcacccaggcugccauugaucagaucaacgggaaacucaaucgccugaucgagaagacgaacgaaaaauuccaucagauugagaaggaguucuccgaaguugagggacggauccaagaccuugaaaaguacguggaggauacaaaaauugaccuguggagcuauaaugccgaacuccuggucgcucuggagaaccagcacaccaucgaucucaccgacucugaaaugaauaagcuguuugagaaaacaagaaagcagcuucgcgagaacgcggaagauaugggcaacgggugcuucaaaauuuaccauaagugugacaaugccugcaucggcuccauucggaacggaaccuacgaucacgacguguauagagacgaggcucugaauaaccgcuuucagaucaagggcguugaacucaaaagcggguacaaggauuggauccuguggauuucuuucgccaucuccugcuuucuucugugugugguccuccugggauucauuaugugggccugccaaaaaggcaauauccgguguaacauuugcaucuga

SEQ ID NO: 185475 - RNA, 1701 nt, Artificial Sequence
  derived and/or modified sequence opt5 from hemagglutinin__InfluenzaA__ACI26571
augaagaccaucauugcccugagcuacaucuucugccucguguuugcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacggcuuccagaacaaggagugggaucuguuugucgaacgcagcaaagccuauuccaauuguuacccuuaugacgugcccgauuacgcuucucucagaagccugguugccuccagcgggacgcuugaguucauuaacgaagacuuuaauuggaccggaguggcucagucuggcggcuccuaugccugcaagcgggggagcgucaacucuuucuuuucccgccugaauuggcuccacgagagcgaguacaaguauccugcgcugaacgugacaaugcccaauaacggaaaauucgauaaacuuuacaucuggggcguucaucacccuucuaccgacagagaacaaacaaagcuguacgugcgggccuccgggcgcgucaccgugagcacgaagagaucccagcagacagugauuccgaauaucggaucucggcccuggguccgcggccucagcuccagaauuagcaucuauuggaccauuguuaaaccuggggauauccugcugaucaacucuacaggaaaccucauugcuccccggggcuacuuuaagauccgcaccggcaaguccagcauuaugagaucugacgccccuaucgggaccuguagcuccgagugcauuacacccaauggaucuaucccgaacgacaaaccuuuccagaaugugaaccggaucacguauggcgcuuguccccgcuacgugaagcaaaauacccugaaacuugccacagggaugagaaacgucccugaaaagcagacccggggaauuuuuggcgcgaucgccggguucauugagaauggaugggagggcaugguggauggcugguauggguuuagacaccagaacagcgaaggaacaggccaggcugccgaccugaaauccacccaagcugccaucgaucagauuaaugggaagcucaaccgccugaucgagaaaacgaaugaaaaguuccaucagaucgagaaggaguucagcgaaguugagggacggauucaagaccuugaaaaauacguggaggauacaaagaucgaccuguggucuuauaacgccgaacuccuggucgcucuggagaaucagcacaccauugaucucaccgacuccgaaaugaacaaacuguuugagaagacaagaaaacagcuucgcgagaaugcggaagauaugggcaacgggugcuucaagaucuaccauaagugugacaacgccugcauuggcagcauccggaauggaaccuacaaccacgauguguauagagacgaggcucugaauaaccgcuuucagauuaaaggcguugaacucaagucuggguacaaagacuggauccuguggaucuccuucgccauuagcugcuuucuucugugugugguccuccugggauucaucaugugggccugccaaaagggcaauauucgguguaacaucugcauuuga

SEQ ID NO: 185476 - RNA, 1701 nt, Artificial Sequence
  derived and/or modified sequence opt5 from hemagglutinin__InfluenzaA__ACI26593
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaagacuucaauuggacaggaguggcucagucuggcgaguccuaugccugcaagcggggcagcgucaaguccuuuuucucucgccucaacuggcugcacaaaagcgauuacaaguauccugcgcuuaaugugaccaugcccaacaaugggaaauuugacaagcuguacauuuggggaguucaucacccuucuacagauagagagcaaaccucccucuacgugcgggccagcggccgcgucacgguguccacaaaaagaucucagcagaccgugaucccgaacauugggagccggcccuggguccgcggacuguccagcagaaucucuauuuauuggacaaucguuaagccuggcgacauucugcucaucaauuccaccgggaaccugaucgcuccccggggauacuucaagauucgcaccggcaaaagcucuaucaugagaagcgacgccccuauuggcacauguuccucugaaugcaucacgcccaacgggagcauuccgaaugauaagccuuuucagaacgugaaucggaucaccuauggagcuuguccccgcuacgugaaacaaaacacacuuaagcuggccaccggcaugagaaaugucccugagaaacagacacgggggaucuucggagcgauugccggcuuuaucgaaaacgggugggagggaaugguggacggcugguauggcuucagacaccaaaauuccgaggggaccggacaggcugccgaucucaagagcacgcaggcugccauugaccagaucaacggcaaacugaaucgccuuauugaaaagacaaacgagaaguuucaucagaucgaaaaagaguucucugaaguugaggggcggauccaagaucuggagaaguacguggaagacaccaaaauugaucucugguccuauaaugccgagcugcuggucgcucucgaaaaccagcacaccaucgaccugacagauagcgagaugaauaaacuuuucgaaaagaccagaaagcagcugcgcgagaacgcggaggacaugggaaauggcugcuuuaagauuuaccauaaaugugauaacgccugcaucgggucuauucggaacggcacauacgaccacgacguguauagagaugaagcucucaauaaccgcuuccagaucaagggaguugagcugaaauccggcuacaaggacuggauucuuuggaucagcuuugccaucuccugcuuccugcucugugugguccugcugggguuuauuaugugggccugccaaaaaggaaauauccgguguaacauuugcaucuga

SEQ ID NO: 185477 - RNA, 1698 nt, Artificial Sequence
  derived and/or modified sequence opt5 from hemagglutinin__InfluenzaA__ACI32715
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacacagucaucgaaaagaugaauacccaguucacagcgguggggaaagaguucuccaaacuggagagacggauggaaaaccucaauaagaagguugacgauggauuucuggacauuuggaccuacaacgccgagcuucuggugcuccuggaaaacgagcgcacgcuugacuuccacgauagcaaugucaaaaaccuguaugaaaaggugaaaucucaacucaagaauaacgcuaaagagaucggcaaugggugcuuugaguucuaccauaaguguaacgacgaaugcauggaguccgucaagaauggcacauaugauuaccccaaauauagcgaagagucuaagcugaacagagagaaaauugacggagugaagcuggaauccaugggcguuuaccagauccucgccauuuauagcaccguggccuccucucugguccuucuggugagccucggggcuaucuccuuuuggaugugcucuaauggaagccugcagugucggaucugcauuuga

SEQ ID NO: 185478 - RNA, 1698 nt, Artificial Sequence
  derived and/or modified sequence opt5 from hemagglutinin__InfluenzaA__ACI32716
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacuccgucaucgaaaagaugaauacacaguucaccgcgguggggaaagaguucagcaaacuggagagacggauggaaaaccucaauaagaagguugacgauggauuucuggacauuuggacauacaacgccgagcuucuggugcuccuggaaaacgagcgcacccuugacuuccacgauucuaaugucaaaaaccuguaugaaaaggugaaaucccaacucaagaauaacgcuaaagagaucggcaaugggugcuuugaguucuaccauaaguguaacgacgaaugcauggagagcgucaagaauggcacguaugauuaccccaaauauucugaagaguccaagcugaacagagagaaaauugacggagugaagcuggaaagcaugggcguuuaccagauccucgccauuuauuccacaguggccucuagccugguccuucuggugucccucggggcuaucucuuuuuggaugugcagcaauggaucccugcaguguaccaucugcauuuga

SEQ ID NO: 185479 - RNA, 1698 nt, Artificial Sequence
  derived and/or modified sequence opt5 from hemagglutinin__InfluenzaA__ACI32717
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaugaacuccagccuuccuuuucagaaugugcaccccgucaccaucggggaguguccuaaauaugugcgcucugccaagcugagaauggcuaccggacuccggaauauccccagcauucagucccgcggccuguucggggccaucgcuggauuuauugaaggcggguggacaggaaugguugacggcugguacggcuaucaucaccagaacgagcaagggucuggauacgccgccgaucagaaaagcacgcagaaugcuaucaacggcauuaccaauaaggugaacuccgucaucgaaaagaugaauacacaguucaccgcgguggggaaagaguucagcaaacuggagagacggauggaaaaccucaauaagaagguugacgauggauuucuggacaucuggacauacaacgccgagcuucuggugcuccuggaaaacgagcgcacccuugacuuccacgauucuaaugucaaaaaccuguaugaaaaggugaaaucccaacucaagaauaacgcuaaagagauuggcaaugggugcuuugaguucuaccauaaguguaacgacgaaugcauggagagcgucaagaauggcacguaugauuaccccaaauauucugaagaguccaagcugaacagagagaaaaucgacggagugaagcuggaaagcaugggcguuuaccagauucucgccaucuauuccacaguggccucuagccugguccuucuggugucccucggggcuauuaauuuuuggaugugcucuaacggaagccugcaguguaaaaucugcaucuga

SEQ ID NO: 185480 - RNA, 1698 nt, Artificial Sequence
  derived and/or modified sequence opt5 from hemagglutinin__InfluenzaA__ACI32718
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgccacaggaguguccgcuagcugcucucacaacggcaaguccagcuuuuaccgcaaucugcuuuggcugaccggcaaaaacgggcucuaucccaaucugucuaaguccuacgccaacaauaaagaaaaggagguucuggugcucuggggaguccaucacccuccgaacaucggcgaucagagagcucuguaccacacagaaaacgccuaugugagcguggucuccucucauuacagccggcgcuucacccccgagauugcgaaaagaccuaagguucgggaccaggaagggcgcaucaauuauuacuggacgcuucuggagcccggagauacaauuaucuuugaggccaacggcaaucucauugcuccuagauucgccuuugcucugucccggggguucggaagcggcaucauuaccucuaacgcccccauggacgaaugugaugcgaagugccagacaccgcaaggcgccaucaauuccagccuuccuuuucagaacgugcaccccgugaccaucggggaguguccuaaauauguccgcucugcuaagcugagaauggccaccggacuccggaauauucccagcauccagucccgcggccuguucggggcuauugccggauuuaucgaaggcggguggacaggaaugguggacggcugguacggcuaucaucaccagaacgagcaagggucuggauacgccgcugaucagaaaagcacgcagaaugcgauuaacggcaucaccaauaagguuaacuccgugaucgaaaagaugaauacacaguucaccgccgucgggaaagaguucagcaaacuggagagacggauggaaaaccucaauaagaagguggacgauggauuucuggacauuuggacauacaacgcugagcuucugguucuccuggaaaacgagcgcacccuugacuuccacgauucuaaugugaaaaaccuguaugaaaaggucaaaucccaacucaagaauaacgccaaagaggugggcaaugggugcuuugaguucuaccauaaguguaacgacgaaugcauggagagcgucaagaauggcacguaugauuaccccaaauauucugaagaguccaagcugaacagagagaaaaucgacggagugaagcuggaaagcaugggcguuuaccagauucucgccaucuauuccacaguggcuucuagccugguccuucuggugucccucggggccauuucuuuuuggaugugcagcaauggaucccugcaguguaccaucugcaucuga

SEQ ID NO: 185481 - RNA, 1698 nt, Artificial Sequence; identical to SEQ ID NO: 185478
  derived and/or modified sequence opt5 from hemagglutinin__InfluenzaA__ACI32719

SEQ ID NO: 185482 - RNA, 1698 nt, Artificial Sequence; identical to SEQ ID NO: 185478
  derived and/or modified sequence opt5 from hemagglutinin__InfluenzaA__ACI32720

SEQ ID NO: 185483 - RNA, 1698 nt, Artificial Sequence
  derived and/or modified sequence opt5 from hemagglutinin__InfluenzaA__ACI32721
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucuccuauuacuggacgcuucuggagcccggagauacaauuaucuuugaggcgaauggcaaccucauugccccuagauucgcuuuugcccugagccggggguucggaucuggcaucauuaccuccaaugcucccauggacgaaugugaugccaagugccagacaccgcaaggcgcgaucaacagcucucuuccuuuucagaaugugcaccccgucaccaucggggaguguccuaaauaugugcgcagcgccaagcugagaauggcuaccggacuccggaacauucccuccauccagucucgcggccuguucggggccauugcuggauuuaucgaaggcggguggacaggaaugguugacggcugguacggcuaucaucaccagaaugagcaagggagcggauacgccgccgaucagaaauccacgcagaacgcuauuaauggcaucaccaacaaggugaauagcgucaucgaaaagaugaacacacaguucaccgcgguggggaaagaguucucuaaacuggagagacggauggaaaaucucaacaagaagguugacgauggauuucuggacauuuggacauacaaugccgagcuucuggugcuccuggaaaacgagcgcacccuugacuuccacgauuccaacgucaaaaaucuguaugaaaaggugaaaagccaacucaagaacaaugcuaaagagaucggcaacgggugcuuugaguucuaccauaaguguaaugacgaaugcauggagucugucaagaacggcacguaugauuaccccaaauauuccgaagagagcaagcugaauagagagaaaauugacggagugaagcuggaauccaugggcguuuaccagauccucgccauuuauucuacaguggccagcucccugguccuucuggugucucucggggcuaucagcuuuuggaugugcuccaacggaagccugcagugucggaucugcauuuga

SEQ ID NO: 185484 - RNA, 1698 nt, Artificial Sequence; identical to SEQ ID NO: 185478
  derived and/or modified sequence opt5 from hemagglutinin__InfluenzaA__ACI32722

SEQ ID NO: 185485 - RNA, 1698 nt, Artificial Sequence
  derived and/or modified sequence opt5 from hemagglutinin__InfluenzaA__ACI32723
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacuccgucaucgaaaagaugaauacacaguucaccgcgguggggaaagaguucagcaaacuggagagacggauggaaaaccucaauaagaagguugacgauggauuucuggacauuuggacauacaacgccgagcuucuggugcuccuggaaaacgagcgcacccuugacuuccacgauucuaaugucaaaaaccuguaugaaaaggugaaaucccaacucaagaauaacgcuaaagagaucggcaaugggugcuuugaguucuaccauaaguguaacgacgaaugcauggagagcgucaagaauggcacguaugauuaccccaaauauucugaagaguccaagcugaacagagagaaaauugacggagugaagcuggaaagcaugggcguuuaccagauccucgccauuuauuccacaguggccucuagccugguccuucuggugucccucggggcuaucucuuuuuggaugugcagcaauggaucccugcagugucggaucugcuucuga

SEQ ID NO: 185486 - RNA, 1698 nt, Artificial Sequence
  derived and/or modified sequence opt5 from hemagglutinin__InfluenzaA__ACI32724
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucugaagcccggagauacaauuaucuuugaggcgaacggcaaucucauugccccuagauucgcuuuugcccugucccggggguucggaagcggcaucauuaccucuaacgcucccauggacgagugugaugccaaaugccagacaccgcaaggcgcgaucaauuccagccuuccuuuucagaacgugcaccccgucaccaucggggaauguccuaaguaugugcgcucugccaaacugagaauggcuaccggacuccggaauauucccagcauccagucccgcggccuguucggggccauugcuggauuuaucgagggcggguggacaggaaugguugacggcugguacggcuaucaucaccagaacgaacaagggucuggauacgccgccgaucaaaagagcacgcagaaugcuauuaacggcaucaccaauaaagugaacuccgucaucgagaagaugaauacacaguucaccgcgguggggaaagaguucagcaagcuggaaagacggauggagaaccucaauaagaaaguugacgauggauuucuggacauuuggacauacaacgccgaacuucuggugcuccuggagaacgaacgcacccuugacuuccacgauucuaaugucaagaaccuguaugagaaagugaagucccagcucaaaaauaacgcuaaggaaaucggcaaugggugcuuugaguucuaccauaaguguaacgacgagugcauggaaagcgucaaaaauggcacguaugauuaccccaaguauucugaggaauccaaacugaacagagagaagauugacggagugaaacuggagagcaugggcguuuaccagauccucgccauuuauuccacaguggccucuagccugguccuucuggugucccucggggcuaucucuuuuuggaugugcagcaauggaucccugcaguguaagaucugcauuuga

SEQ ID NO: 185487 - RNA, 1698 nt, Artificial Sequence; identical to SEQ ID NO: 184409
  derived and/or modified sequence opt5 from hemagglutinin__InfluenzaA__ACI32725

SEQ ID NO: 185488 - RNA, 1698 nt, Artificial Sequence
  derived and/or modified sequence opt5 from hemagglutinin__InfluenzaA__ACI32726
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaauggcuaccggacuccggaauauucccagcauccagucccgcggccuguucggggccauugcuggauuuaucgaaggcggguggacaggaaugguugacggcugguacggcuaucaucaccagaacgagcaagggucuggauacgccgccgaucagaaaagcacgcagaaugcuauuaacggcaucaccaauaaggugaacuccgucaucgaaaagaugaauacacaguucaccgcgguggggaaagaguucagcaaacuggagaagagaauggaaaaccucaauaagaaaguugacgauggauuucuggacauuuggacauacaacgccgagcuucuggugcuccuggaaaacgagcggacccuugacuuccacgauucuaaugucaagaaccuguaugaaaaagugaagucccaacucaaaaauaacgcuaaggagaucggcaaugggugcuuugaguucuaccauaaguguaacgacgaaugcauggagagcgucaaaaauggcacguaugauuaccccaaguauucugaagaguccaaacugaaccgcgagaagauugacggagugaaacuggaaagcaugggcaucuaccagauucucgccaucuauuccacaguuaccucuagccuggugcuucuggucucccucggggccaucucuuuuuggaugugcagcaauggaucccugcaguguagaauuugcaucuga

SEQ ID NO: 185489 - RNA, 1698 nt, Artificial Sequence
  derived and/or modified sequence opt5 from hemagglutinin__InfluenzaA__ACI32727
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucuaucagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuccgaacauuggcgaucagagagcccuguaccacacagaaaacgcuuaugugagcguggucuccucucauuacagccggcgcuucacccccgagaucgccaaaagaccuaagguucgggaccaggaagggcgcauuaauuauuacuggacgcuucuggagcccggagauacaaucauuuuugaggcgaacggcaaucucaucgccccuagauucgcuuuugcccugucccggggguucggaagcggcauuaucaccucuaacgcucccauggacgaaugugaugccaagugccagacaccgcaaggcgcgaucaauuccagccuuccuuuucagaacgugcaccccgugaccauuggggaguguccuaaauauguccgcucugccaagcugagaauggcuaccggacuccggaauauccccagcauucagucccgcggccuguucggggccaucgcuggauuuauugaaggcggguggacaggaaugguggacggcugguacggcuaucaucaccagaacgagcaagggucuggauacgccgccgaucagaaaagcacgcagaaugcuaucaacggcaucaccaauaagguuaacuccgugauugaaaagaugaauacacaguucaccgcggucgggaaagaguucagcaaacuggagagacggauggaaaaccucaauaagaagguggacgauggauuucuggacaucuggacauacaacgccgagcuucugguucuccuggaaaacgagcgcacccuugacuuccacgauucuaaugugaaaaaccuguaugaaaaggucaaaucccaacucaagaauaacgcuaaagagauuggcaaugggugcuuugaguucuaccauaaguguaacgacgaaugcauggagagcgugaagaauggcacguaugauuaccccaaauauucugaagaguccaagcugaacagagagaaaaucgacggagucaagcuggaaagcaugggcguguaccagauucucgccaucuauuccacaguugccucuagccuggugcuucuggucacccucggggcuaucuccuuuuggaugugcucuaauggaagccugcaguguaccauuugcaucuga

SEQ ID NO: 185490 - RNA, 1698 nt, Artificial Sequence
  derived and/or modified sequence opt5 from hemagglutinin__InfluenzaA__ACI32729
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucccgaaagaguccuggucuuacauuguggaaacccccaauccugagaacggcacguguuaucccggguacuuugccgacuaugaggaacugagagagcaacucagcuccgucucuagcuucgaacgguuugagaucuucccuaaggaguccagcuggcccaaucauaccgugacaggaguuucugccuccugcagccacaacggcaagucuuccuuuuaccgcaaucugcuuuggcugaccggcaaaaacgggcucuauccuaaucugagcaagucuuacgcuaacaauaaagaaaaggaggugcugguccucuggggagugcaucacccgcccaacaucggcgaucagagagcccuguaccacacagaaaacgcuuauguguccgucguuagcucccauuacucucggcgcuucaccccugagauugccaaaagacccaaggugcgggaccaggaagggcgcaucaauuauuacuggacgcuucuggagccuggagauacaauuaucuuugaggcgaacggcaaucucauugcccccagauucgcuuuugcccugagccggggguucggauccggcaucauuaccagcaacgcuccgauggacgaaugugaugccaagugccagacaccucaaggcgcgaucaauucuucccuucccuuucagaacgugcacccugucaccaucggggagugucccaaauaugugcgcagcgccaagcugagaaugguuaccggacuccggaauauucccucuauccagagccgcggccuguucggggcuauugccggauuuaucgaaggcggguggacaggaaugguggacggcugguacggcuaucaucaccagaacgagcaaggguccggauacgcugccgaucagaaaucuacgcagaaugccauuaacggcgucaccaauaaggugaacagcguuaucgaaaagaugaauacacaguucaccgcuguggggaaagaguucaacaaacuggagagacggauggaaaaucucaacaagaaggucgacgauggauuucuggacaucuggacauacaacgcggagcuucuggugcuccuggaaaaugagcgcacccuugacuuccacgauuccaacgucaaaaaucuguaugaaaaggugaaaagccaacucaagaacaaugccaaagagauuggcaacgggugcuuugaguucuaccauaaguguaaugacgaaugcauggagucuguuaagaacggcacguaugauuacccuaaauauuccgaagagagcaagcugaauagagagaaaaucgacggagugaagcuggaaucuaugggcgucuaccagauucucgcuaucuauuccacaguggccagcucccugguucuucuggugucucucggggccauuagcuuuuggaugugcuccaacggaucucugcagugucggaucugcaucuga

SEQ ID NO: 185491 - RNA, 1698 nt, Artificial Sequence; identical to SEQ ID NO: 185490
  derived and/or modified sequence opt5 from hemagglutinin__InfluenzaA__ACI32730

SEQ ID NO: 185492 - RNA, 1698 nt, Artificial Sequence
  derived and/or modified sequence opt5 from hemagglutinin__InfluenzaA__ACI32731
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagaaggcccuguaccauaccgaaaacgcuuacgugagcgucguuuccucucacuauagccgcaaauucaaucccgagauugccaagagaccuaaagugcgggaccaggaagggcgcaucaacuacuauuggacacuucuggagcccggagauaccauuaucuuugaggcgaauggcaaccucauugccccuagauacgcuuucgcccugucccggggguuuggaagcggcaucauuaauucuaacgcucccauggacgaaugugaugccaagugccagacgccgcaaggcgcgaucaauuccagccuuccuuuccagaacgugcaucccgucacaaucggggaguguccuaaauaugugcgcucugccaagcugagaaugguuaccggacuccggaauauucccagcauccagucccgcggccuguuuggggcuauugccggauucaucgaaggcggguggacaggaaugguggacggcugguacggcuaucaccaccagaacgagcaagggucuggauacgcugccgaucagaaaagcacccagaaugccauuaacggcaucaccaauaaggucaacuccgugaucgaaaagaugaauacacaguuuacggcuguugggaaagaguucaacaagcuggagagacggauggaaaaccucaauaaaaagguggacgauggauucauugacaucuggaccuacaacgcggagcugcuuguccugcucgaaaaugagcgcacacuggacuuucaugauagcaacgugaaaaaucuuuaugaaaaggucaagucucaacugaaaaacaaugccaaggagauuggcaacgggugcuucgaguuuuaccacaaauguaaugacgaaugcauggaguccgugaagaacggcaccuaugauuaccccaaauauagcgaagagucuaagcucaauagagagaagaucgacggaguuaaacuggaauccaugggcguguaccagauucuggcuaucuauagcacagucgccuccucucucgugcugcuuguuagccugggggccaucuccuucuggaugugcucuaacggaagccuccaguguaagauuugcaucuga

SEQ ID NO: 185493 - RNA, 1698 nt, Artificial Sequence
  derived and/or modified sequence opt5 from hemagglutinin__InfluenzaA__ACI32732
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaagaaaaggaggugcugguccucuggggagugcaucacccuccgaacaucggcgaucagagagcccuguaccacacagaaaacgcuuaugugagcgucguuuccucucauuacagccggcgcuucacccccgagauugccaaaagaccuaaggugcgggaccaggaagggcgcaucaauuauuacuggacgcuucuggagcccggagauacaauuaucuuugaggcgaacggcaaucucauugccccuagauucgcuuuugcccugucccggggguucggaagcggcaucauuaccucuaacgcucccauggacgaaugugaugccaagugccagacaccgcaaggcgcgaucaauuccagccuuccuuuucagaacgugcaccccgucaccaucggggaguguccuaaauaugugcgcucugccaagcugagaaugguuaccggacuccggaauauucccagcauccagucccgcggccuguucggggcuauugccggauuuaucgaaggcggguggacaggaaugguggacggcugguacggcuaucaucaccagaacgagcaagggucuggauacgcugccgaucagaaaagcacgcagaaugccauuaacggcaucaccaauaaggucaacuccgugaucgaaaagaugaauacacaguucaccgcuguugggaaagaguucaacaaacuggagagacggauggaaaaucucaacaagaagguggacgauggauuucuggacauuuggacauacaacgcggagcuucugguccuccuggaaaaugagcgcacccuugacuuccacgauagcaacgugaaaaaucuguaugaaaaggucaaaucucaacucaagaacaaugccaaagagaucggcaacgggugcuuugaguucuaccauaaguguaaugacgaaugcauggaguccgugaagaacggcacguaugauuaccccaaauauagcgaagagucuaagcugaauagagagaaaauugacggaguuaagcuggaauccaugggcguguaccagauccucgcuauuuauagcacagucgccuccucucuggugcuucugguuagccucggggccaucuccuuuuggaugugcucuaacggaagccugcaguguaccaucugcauuuga

SEQ ID NO: 185494 - RNA, 1698 nt, Artificial Sequence
  derived and/or modified sequence opt5 from hemagglutinin__InfluenzaA__ACI32733
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccgaaucccgagaacggcaccuguuauccugggcauuuugccgacuacgaggaacugagagagcaacucuccucugucagcuccuucgaacgguuugagaucuuccccaaggagagcucuuggccuaaucacacggugaccggaguuuccgccagcugcucucauaacggcaaauccagcuuuuauaagaaucugcuuuggcugacaggcaaaaacgggcucuaccccaaucugucuaaguccuaugcuaacaauaaagaaaaggaggugcugguccucuggggagugcaccacccuccgaacaucggcgaucagaaggcccuguaccauaccgaaaacgcuuacgugagcgucguuuccucucacuauagccgcaaauucaauuccgagauugccaagagacccaaagugcgggaccaggaagggcgcaucaacuacuauuggacacuucuggagccuggagauaccauuaucuuugaggcgaauggcaaccucauugcccccagauacgcuuucgcccugagccggggguuuggaucuggcaucauuaauuccaacgcuccuauggacgaaugugaugccaagugccagacgccccaaggcgcgaucaauagcucucuuccguuccagaacgugcauccugucacaaucggggagugucccaaauaugugcgcagcgccaagcugagaaugguuaccggacuccggaauauuccuuccauccagucucgcggccuguuuggggcuauugccggauucaucgaaggcggguggacaggaaugguggacggcugguacggcuaucaccaccagaacgagcaagggagcggauacgcugccgaucagaaauccacccagaaugccauuaacggcaucaccaauaaggucaacagcgugaucgaaaagaugaauacacaguuuacggcuguugggaaagaguucaacaagcuggagagacggauggaaaaccucaauaaaaagguggacgauggauucauugacaucuggaccuacaacgcggagcugcuuguccugcucgaaaaugagcgcacacuggacuuucaugauucuaacgugaaaaaucuuuaugaaaaggucaagucccaacugaaaaacaaugccaaggagauuggcaacgggugcuucgaguuuuaccacaaauguaaugacgaaugcauggagagcgugaagaacggcaccuaugauuaccccaaauauucugaagaguccaagcucaauagagagaagaucgacggaguuaaacuggaaagcaugggcguguaccagauucuggcuaucuauuccacagucgccucuagccucgugcugcuuguuucccugggggccaucucuuucuggaugugcagcaacggaucccuccaguguaccauuugcaucuga

SEQ ID NO: 185495 - RNA, 1698 nt, Artificial Sequence
  derived and/or modified sequence opt5 from hemagglutinin__InfluenzaA__ACI32734
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucuaaguccuacgcuaacaauaaaaagaaagaagugcugguccucuggggagugcaucacccuccgaacaucggcgaucagaaggcccuguaccacacagagaacgcuuaugugagcgucguuuccucucauuacagcagacgguucacccccgaaauugccaagcgcccuaaagugagagaccaggaggggcggaucaauuauuacuggacgcuucuggaacccggagauacaauuaucuuugaggcgaacggcaaucucauugccccucgcuucgcuuuugcccuguccagaggguucggaagcggcaucauuaccucuaacgcucccauggacgagugugaugccaagugccagacaccgcaaggcgcgaucaauuccagccuuccuuuucagaacgugcaccccgucaccaucggggaauguccuaaauaugugcggucugccaagcugcgcaugguuaccggacucagaaauauucccagcauccagucccggggccuguucggggcuauugccggauuuaucgagggcggguggacaggaaugguggacggcugguacggcuaucaucaccagaacgaacaagggucuggauacgcugccgaucagaaaagcacgcagaaugccauuaacggcaucaccaauaaggucaacuccgugaucgagaaaaugaauacacaguucaccgcuguugggaaggaguucaacaagcuggaacgcagaauggagaaucucaacaaaaagguggacgauggauuucuggacauuuggacauacaacgcggaacuucugguccuccuggagaaugaacggacccuugacuuccacgauagcaacgugaaaaaucuguaugagaaggucaaaucucaacucaagaacaaugccaaggaaaucggcaacgggugcuuugaguucuaccauaaauguaaugacgagugcauggaauccgugaagaacggcacguaugauuaccccaaauauagcgaggaaucuaagcugaaucgcgagaaaauugacggaguuaagcuggaguccaugggcguguaccagauccucgcuauuuauagcacagucgccuccucucuggugcuucugguuagccucggggccaucuccuuuuggaugugcucuaacggaagccugcaguguaccaucugcauuuga

SEQ ID NO: 185496 - RNA, 1698 nt, Artificial Sequence
  derived and/or modified sequence opt5 from hemagglutinin__InfluenzaA__ACI32736
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacggccaccggaguguccgcuagcugcucucauaacggcaaguccagcuuuuauaaaaaucugcuuuggcugacaggcaagaacgggcucuaccccaaucugucuaaauccuaugccaacaauaaggaaaaagagguucuggugcucuggggaguccaccacccuccgaacaucggcgaucagagagcucuguaccauaccgaaaacgccuacgugagcguggucuccucucacuauagccggaaguucacacccgagauugcgaagcgcccuaaaguuagagaccaggaagggcggaucaauuacuauuggacccuucuggagcccggagauacgauuaucuuugaggccaacggcaaucucauugcuccucgcuacgccuucgcucuguccagaggguuuggaagcggcaucauuaacucuaaugcccccauggacgaaugugaugcgaagugccagacaccgcaaggcgccaucaacuccagccuuccuuuccagaaugugcaucccgugaccaucggggaguguccuaaauauguccggucugcuaagcugcgcauggugacaggacucagaaacauucccagcauccagucccggggccuguuuggggccauugcuggauucaucgaaggcggguggaccggaaugguugacggcugguacggcuaucaccaccagaaugagcaagggucuggauacgccgccgaucagaaaagcacccagaacgcuauuaauggcaucacaaacaaggucaauuccgugaucgaaaagaugaacacgcaguuuaccgcgguggggaaagaguucaauaagcuggagcgcagaauggaaaaccucaacaaaaagguugacgauggauucauugacaucuggacauacaaugccgagcugcuugugcugcucgaaaacgagcggacccuggacuuucaugauagcaauguccgcaaccuuuaugaaaaagugaagucucaacugaaaaauaacgcuaaggagauuggcaaugggugcuucgaguuuuaccacaaguguaacgacgaaugcauggaguccgucaaaaauggcacauaugauuaccccaaguauagcgaagagucuaaacucaacagagagaagaucgacggagugaaacuggaauccaugggcguuuaccagauucuggccaucuauagcaccguggccuccucucucguccugcuugugagccugggggcuaucuccuucuggaugugcucuaauggaagccuccagugucggauuugcaucuga

SEQ ID NO: 185497 - RNA, 1698 nt, Artificial Sequence
  derived and/or modified sequence opt5 from hemagglutinin__InfluenzaA__ACI32737
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucccgaaagaguccuggucuuacauuguggaaauccccaacccugagaauggcaccuguuaucccggguacuuugccgauuaugaggaacugagagagcaacucagcuccgucucuagcuucgaacgguuugagaucuucccuaaggaguccagcuggcccaaccauacggugaccggaguuucugccuccugcagccacaauggcaagucuuccuuuuaccgcaaccugcuuuggcugacaggcaaaaaugggcucuauccuaaccugagcaagucuuacgcuaauaacaaagaaaaggaggugcugguccucuggggagugcaucacccgcccaacauuggcgaccagagagcccuguaccacaccgaaaaugcuuauguguccgucguuagcucccauuacucucggcgcuucacaccugagaucgccaaaagacccaaggugcgggaucaggaagggcgcauuaacuauuacuggacccuucuggagccuggagacacgaucauuuuugaggcgaauggcaaccucaucgcccccagauucgcuuuugcccugagccgggggcuuggauccggcauuaucacaagcaaugcuccgauggaugaaugugacgccaagugccagaccccucaaggcgcgaucaacucuucccugcccuuccagaaugugcacccugucacaauuggggagugucccaaauaugugcgcagcgccaagcucagaaugguuaccggacugcggaacauccccucuauucagagccgcggccuguuuggggcuaucgccggauucauugaaggcggguggaccggaaugguggauggcugguacggcuaucaucaccagaaugagcaaggguccggauacgcugccgaccagaaaucuacacagaacgccaucaauggcaucacgaacaaggucaauagcgugauugaaaagaugaacacccaguuuacagcuguugggaaagaguucaauaaacucgagagacggauggaaaaccugaacaagaagguggaugacggauuccuugauaucuggaccuacaaugcggagcugcucguccugcuugaaaacgagcgcacacuggacuuucacgacuccaaugugaaaaaccucuaugaaaaggucaaaagccaacugagaaauaacgccaaggagauuggcaaugggugcuucgaguuuuaccauaaauguaacgaugaaugcauggagucugugaagaauggcaccuaugacuacccuaaguauuccgaagagagcaaacugaaccgggagaagaucgauggaguuaaacucgaaucuaugggcguguaccagauucuggcuaucuauuccacggucgccagcucccuugugcugcucguuucucugggggccaucagcuucuggaugugcuccaauggaucucugcaguguagaauuugcaucuga

SEQ ID NO: 185498 - RNA, 1698 nt, Artificial Sequence
  derived and/or modified sequence opt5 from hemagglutinin__InfluenzaA__ACI32739
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucugauucucuggggagugcaucacccuccgaacaucggcaaccagagaacacuguaccacaccgaaaaugccuaugucagcgugguguccucucauuacagccggcgcuucacgcccgagauuacaaaaagaccuaagguccgggaucaggaagggcgcaucaacuauuacuggacccuucuggagcccggagacacaauuaucuuugaggcuaauggcaaccucauugccccuugguaugcguucgcccuguccagaggguuuggaagcggcaucaucaccucuaaugcucccauggaugaaugugacgccaagugccagaccccgcaaggcgcuauuaacuccagccuuccuuuccagaauguucaccccgugacaaucggggaguguccuaaauacgugcggucugccaagcugcgcauggucacgggacucagaaacauucccagcauccagucccggggccuguuuggggcgauugccggauucaucgaaggcggguggaccggaaugguggauggcugguauggcuaccaucaccagaaugagcaagggucuggauacgcugccgaccagaaaagcacacagaacgcuaucaauggcauuaccaacaagguuaauuccgugaucgaaaagaugaacacacaguuuaccgccgucgggaaagaguucaauaaacuggagcgcagaauggaaaaccucaacaagaagguggaugacggauuccuggauauuuggacguauaaugccgagcuucugguucuccuggaaaacgagcggacacuugacuuucacgacagcaaugugaaaaaccuguacgaaaaggucaaaucucaacucaagaauaacgcuaaagagaucggcaaugggugcuucgaguuuuaucauaaguguaacaaugaaugcauggaguccgugaagaacggcaccuacgauuaucccaaauacagcgaagagucuaagcugaaucgcgagaaaauugacggagucaagcuggaauccaugggcguguaucagauccucgcgaucuacagcaccguugccuccucucuggugcuucuggucagccucggggcuauuuccuucuggaugugcucuaacggaagccugcaguguaaaaucugcauuuga

SEQ ID NO: 185499 - RNA, 1698 nt, Artificial Sequence
  derived and/or modified sequence opt5 from hemagglutinin__InfluenzaA__ACI32740
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaagcauacggucaccggaguguccgcuagcugcucucacaauggcaaauccagcuuuuaccgcaaccugcuuuggcugacaggcaagaaugggcucuaucccaaccugucuaaauccuacgccaauaacaaggaaaaagagguucugauucucuggggagugcaucacccuccgaauaucggcgaucagagaacccuguaccacacagaaaacgcuuaugucagcgugguguccucucauuacagccggcgcuucacccccgagauuacgaagagaccuaagguccgggaccaggaagggcgcaucaacuauuacuggacacuucuggagcccggagauaccauuaucuuugaggccaauggcaaccucauugcgccuugguaugccuucgcucuguccagaggguuuggaagcggcaucaucacaucuaaugcccccauggacgaaugugaugcuaaaugccagaccccgcaaggcgccauuaacuccagccuuccuuuccagaauguucaccccgugaccaucggggaguguccuaaguacgugcggucugcgaaacugcgcauggucacaggacucagaaacauucccagcauccagucccggggccuguuuggggccauugcuggauucaucgaaggcggguggacgggaaugguggacggcugguauggcuaccaucaccagaaugagcaagggucuggauacgccgcugaucaaaagagcacccagaacgccaucaauggcauuacaaacaaaguuaauuccgugaucgaaaagaugaacacccaguuuacagccgucgggaaagaguucaauaagcuggagcgcagaauggaaaaccucaauaagaaaguggacgauggauuccuggacauuuggaccuauaacgcugagcuucugguucuccuggaaaacgagcggacgcuugacuuucacgauagcaaugugaagaaccuguacgaaaaagucaagucucagcucaaaaauaacgcgaaggagaucggcaaugggugcuucgaguuuuaucauaaguguaacaaugaaugcauggaguccgugaaaaacggcacauacgacuaucccaaguacagcgaagagucuaaacugaaucgcgagaagauugauggagucaaacuggacuccaugggcguguaucagauccucgccaucuacagcaccguugcuuccucucuggugcuucuggucagccucggggccauuuccuucuggaugugcccuaacggaucucugcaguguaccaucugcauuuga

SEQ ID NO: 185500 - RNA, 1698 nt, Artificial Sequence
  derived and/or modified sequence opt5 from hemagglutinin__InfluenzaA__ACI32741
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaggagagcucuuggccuaagcauacggucaccggaguguccgcuagcugcucucacaauggcaaauccagcuuuuaccgcaaccugcuuuggcugacaggcaagaaugggcucuaucccaaccugucuaaauccuacgccaauaacaaggaaaaagagguucugauucucuggggagugcaucacccuccgaauaucggcgaucagagaacccuguaccacacagaaaacgcuuaugucagcgugguguccucucauuacagccggcgcuucacccccgagauuacgaagagaccuaagguccgggaccaggaagggcgcaucaacuauuacuggacacuucuggagcccggagauaccauuaucuuugaggccaauggcaaccucauugcgccuugguaugccuucgcucuguccagaggguuuggaagcggcaucaucacaucuaaugcccccauggacgaaugugaugcuaaaugccagaccccgcaaggcgccauuaacuccagccuuccuuuccagaauguucaccccgugaccaucggggaguguccuaaguacgugcggucugcgaaacugcgcauggucacaggacucagaaacauucccagcauccagucccggggccuguuuggggccauugcuggauucaucgaaggcggguggacgggaaugguggacggcugguauggcuaccaucaccagaaugagcaagggucuggauacgccgcugaucaaaagagcacccagaacgccaucaauggcauuacaaacaaaguuaauuccgugaucgaaaagaugaacacccaguuuacagccgucgggaaagaguucaauaagcuggagcgcagaauggaaaaccucaauaagaaaguggacgauggauuccuggacauuuggaccuauaacgcugagcuucugguucuccuggaaaacgagcggacgcuugacuuucacgauagcaaugugaagaaccuguacgaaaaagucaagucucagcucaaaaauaacgcgaaggagaucggcaaugggugcuucgaguuuuaucauaaguguaacaaugaaugcauggaguccgugaaaaacggcacauacgacuaucccaaguacagcgaagagucuaaacugaaucgcgagaagauugauggagucaaacuggacuccaugggcguguaucagauccucgccaucuacagcaccguugcuuccucucuggugcuucuggucagccucggggccauuuccuucuggaugugcccuaacggaucucugcaguguaagaucugcauuuga

SEQ ID NO: 185501 - RNA, 1698 nt, Artificial Sequence
  derived and/or modified sequence opt5 from hemagglutinin__InfluenzaA__ACI32742
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucugauucucuggggagugcaucacccuccgaacaucggcgaucagagaacacuguaccacaccgaaaacgccuaugucagcgugguguccucucauuacagccggcgcuucacgcccgagauuacaaaaagaccuaagguccgggaccaggaagggcgcaucaauuauuacuggacccuucuggagcccggagauacaauuaucuuugaggcuaacggcaaucucauugccccuugguaugcguucgcccuguccagaggguuuggaagcggcaucaucaccucuaacgcucccauggacgaaugugaugccaagugccagaccccgcaaggcgcuauuaauuccagccuuccuuuccagaacguucaccccgugacaaucggggaguguccuaaauacgugcggucugccaagcugcgcauggucacgggacucagaaauauucccagcauccagucccggggccuguuuggggcgauugccggauucaucgaaggcggguggaccggaaugguggacggcugguauggcuaccaucaccagaacgagcaagggucuggauacgcugccgaucagaaaagcacacagaaugcuaucaacggcauuaccaauaagguuaacuccgugaucgaaaagaugaauacacaguuuaccgccgucgggaaagaguucaacaaacuggagcgcagaauggaaaaucucaacaagaagguggacgauggauuccuggacauuuggacguauaacgccgagcuucugguucuccuggaaaaugagcggacacuugacuuucacgauagcaacgugaaaaaucuguacgaaaaggucaaaucucaacucaagaacaaugcuaaagagaucggcaacgggugcuucgaguuuuaucauaaguguaauaacgaaugcauggaguccgugaagaauggcaccuacgacuaucccaaauacagcgaagagucuaagcugaaccgcgagaaaauugauggagucaagcuggacuccaugggcguguaucagauccucgcgaucuacagcaccguugccuccucucuggugcuucuggucagccucggggcuauuuccuucuggaugugcucuaauggaagccugcaguguaaaaucugcauuuga

SEQ ID NO: 185502 - RNA, 1698 nt, Artificial Sequence
  derived and/or modified sequence opt5 from hemagglutinin__InfluenzaA__ACI32743
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcgccuguuauccuggguacuuugccgacuaugaggaacugagagagcaacucuccucugugagcuccuucgaacgguuugagaucuuccccaaaaagagcucuuggccuaaucauacggucaccggaguguccgcuagcugcucucacaacggcaaguccagcuuuuaccgcaaucugcuuuggcugacaggcaagaacgggcucuaucccaaucugucuaaauccuacgccaacaauaaggagaaagaaguucugauucucuggggagugcaucacccuccgaacaucggcaaccagagaacccuguaccacacagagaaugcuuaugucagcgugguguccucucauuacagccggcgcuucacccccgaaauuacgaagagaccuaagguccgggaucaggaggggcgcaucaacuauuacuggacacuucuggaacccggagacaccauuaucuuugaggccaauggcaaccucauugcgccuugguaugccuucgcucuguccagaggguuuggaagcggcaucaucacaucuaaugcccccauggaugagugugacgcuaaaugccagaccccgcaaggcgccauuaacuccagccuuccuuuccagaauguucaccccgugaccaucggggaauguccuaaguacgugcggucugcgaaacugcgcauggucacaggacucagaaacauucccagcauccagucccggggccuguuuggggccauugcuggauucaucgagggcggguggacgggaaugguggauggcugguauggcuaccaucaccagaaugaacaagggucuggauacgccgcugaccaaaagagcacccagaacgccaucaauggcauuacaaacaaaguuaauuccgugaucgagaagaugaacacccaguuuacagccgucgggaaagaguucaauaagcuggaacgcagaauggagaaccucaacaagaaaguggaugacggauuccuggauauuuggaccuauaaugcugaacuucugguucuccuggagaacgaacggacgcuugacuuucacgacagcaaugugaagaaccuguacgagaaagucaagucucagcucaaaaauaacgcgaaggaaaucggcaaugggugcuucgaguuuuaucauaaguguaacaaugagugcauggaauccgugaaaaacggcacauacgauuaucccaaguacagcgaggaaucuaaacugaaucgcgagaagauugacggagucaaacuggauuccaugggcguguaucagauccucgccaucuacagcaccguugcuuccucucuggugcuucuggucagccucggggccauuuccuucuggaugugcucuaacggaagccugcaguguagaaucugcauuuga

SEQ ID NO: 185503 - RNA, 1701 nt, Artificial Sequence
  derived and/or modified sequence opt5 from hemagglutinin__InfluenzaA__ACJ09818
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaguggaggugacaaacgcuaccgaacugguccagucuagcuccacaggcgagauuugcgacucuccgcaccagauccuugauggggaaaauuguacccugaucgacgcccuccugggagauccccagugcgacggcuuucaaaacaaaaagugggaucuguucguggagagaagcaaagccuauuccaauuguuacccuuaugacguucccgauuacgcuucucuccggagccugguggccuccagcgggacgcuugaauuuaacaaugagucuuucaacuggaccggagucacacagaauggcaccuccagcgcuugcauucgcagaucuaacaauuccuuuuucagccggcugaacuggcucacacaucugaaguuuaaguauccugcccuuaaugugaccaugcccaacaacgagaaauucgacaagcuguacaucuggggcguucaccauccugggacggauaaugaccagauuuuucucuaugcgcaggccucuggacgcaucacaguguccaccaaaagaagccaacagacagucauuccgaacaucggcucccggccccgcgugagaaauauuccuucucggaucagcaucuacuggaccauugugaagcccggggauauccugcugauuaacuccaccggaaaucucaucgcuccucgcggcuacuucaaaauuagaagcgggaagucuuccaucaugcggagcgacgcccccaucggaaaguguaacucugaaugcauuacaccgaauggcagcaucccuaacgacaaacccuuucagaaugucaaccgcauuacguauggcgcuuguccuagauacguuaagcagaauacccugaaacuugccacagggaugcggaacgugcccgagaagcaaacccgcggaaucuucggcgcgauugccggguuuaucgaaaauggaugggagggcaugguggaugggugguauggauucagacaccagaacuccgagggcaucggccaggcugccgaccugaaaucuacacaagcugccauugaucagaucaaugggaagcucaaccggcugauuggaaaaaccaacgaaaaguuccaccagaucgagaaggaauuuagcgaggucgaaggccgcauucaggaccuugagaaauacguggaggauacgaagaucgaccugugguccuauaaugccgaacuccugguugcucuggagaaccaacauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcgucgaacucaaauccggauacaaggauuggauucuguggaucagcuuugccaugucuugcuuccuucuguguguggcccuccugggcuuuauuaugugggcuugccagaaagggaacauccgguguaauaucugcauuuga

SEQ ID NO: 185504 - RNA, 1683 nt, Artificial Sequence
  derived and/or modified sequence opt5 from hemagglutinin__InfluenzaA__ACJ67533
auggagaccaucagccugauuacaauccuccugguggucacggccuccaacgcugacaagauuugcaucggccaccagucuaccaauagcacagaaaccguugauacacuuaccgagacaaacgugcccgugacccaugccaaagaacugcuccacacggagcauaaugggaugcugugugcgaccucccuuggacacccucugauucucgacacaugcaccaucgaaggccuggucuacgggaacccgucuugugaucugcuccuggagggaagagaguggagcuauaucguggaacgguccucugcuguuaauggcacaugcuaccccgggaacguggagaaucuugaggaacugcgcacccucuucagcuccgccagcucuuaucaacggauucagaucuuuccugacacgacauggaacgucaccuacacaggaaccuccagagccuguagcggcucuuucuaucgcuccaugagauggcugacccaaaagagcggcuuuuaccccgugcaggaugcucaguauacaaauaaccgggggaaaucuauucuuuucguuuggggaauccaucacccucccacguacgccgagcagaccaaucuguacauucgcaacgacacaaccacauccgugaccacggaagaucucaauagaacauuuaagccugucaucggcccgcggccccuggugaacgggcugcagggacgcauugacuauuacuggagcgugcucaaaccuggccagacccugagaguccgguccaaugggaaccuuaucgcucccugguauggacacguucugucuggcggcagccaugggcgcauccucaagaccgaucugaaguccggaagcugcguggugcaaugucagacagagaaaggcgggcuuaacucuacccugccuuuccacaauauuuccaaguacgccuuuggaacaugccccaaauaugucagagugaacagccucaagcuggcgguuggccugcggaaugugccggcccgcucuagcagaggacucuucggggcuaucgccggcuuuauugaaggcggguggccuggacuggucgcuggcugguacggguuccagcauuccaacgaccagggagugggcauggccgcggaucgggacucuacgcaaaaagccaucgauaagauuaccagcaagguuaauaacaucguggacaaaaugaauaagcaguaugagaucauugaccacgaauuuuccgaggucgagacaagacuuaacaugaucaauaacaaaauugaugaccagauccaagaugugugggcuuacaaugccgaacugcucguccugcuugagaaccagaagacccuggacgaacacgaugcuaaugugaacaaucucuacaacaaaguuaagcgcgcccuggggagcaacgccauggaggacggcaaaggauguuucgaacuguaucauaagugcgaugaccaguguauggagacaauucggaauggcaccuacaacagacgcaaguaucgggaggaaucuagacucgagcgccagaaaaucgaaggggugaagcuggaguccgaacggacguacaaaauccuuaccauuuauagcacagucgcuucuucccuggugcucgcgaugggauuugccgcuuuccuguucugggccaugagcaauggcuccugcagaugcaacaucuguauuuga

SEQ ID NO: 185505 - RNA, 1704 nt, Artificial Sequence
  derived and/or modified sequence opt5 from hemagglutinin__InfluenzaA__ACJ68607
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugggcgauugcagcguugcgggguggcuccugggaaacccuaugugugacgaguucaucaaugugccggaaugguccuauauugucgagaaggcuaaccccgccaaugaucugugcuacccuggcaacuuuaaugacuaugaggaacucaagcaucugcuuucuagaaucaaccacuucgagaaaauucagaucauucccaagagcuccuggucugaucaugaagccagcuccggggugagcucugcuuguccuuaccagggaacccccuccuuuuuccggaauguuguguggcugaucaaaaagaacaauacauauccuaccauuaaacgcagcuacaacaauacaaaccaagaggaccuccugauccuuuggggcauccaccacucuaacgaugccgcugagcagaccaagcuguaucagaauccgacgaccuacauuuccgucggcacaagcacccucaaccagagacuggugcccaagaucgccacacggucuaaagugaaugggcaauccggacgcauggacuuuuucuggaccauucugaagccuaacgaugcgaucaauuuugaaagcaacggcaauuucauugcccccgaguacgcuuauaaaaucgucaagaaaggggacuccgccaucaugaagucugaaguugaguacggaaacugcaauacgaaaugucagacaccuauuggcgcuaucaacagcuccaugcccuuucauaauauucacccgcucaccaucggggaaugcccuaaguaugugaaaagcaacaaacuggugcuugccacaggacugagaaauucuccccuccgggagcgcagacggaagcgcggccuguucggcgcgauugccggguuuaucgagggaggcuggcaggggauggucgacggaugguacggcuaucaucacuccaacgaacaggggagcggauacgcugccgauaaagagucuacccaaaaggcuaucgacggcgugaccaauaaaguuaacagcauuaucgauaagaugaacacacaguucgaagccgugggcagagaguuuaauaaccuugaacggcgcauugagaaucugaacaagaaaauggaggacggguuccucgaugucuggacguauaaugccgaacugcuggugcucauggagaacgaaagaacccuggacuuccacgauuccaauguuaagaaccuuuacgacaaagugcggcugcagcuccgcgauaaugcuaaggagcugggaaacggcuguuuugaguucuaccauaaaugcgacaaugaauguauggagucugucagaaacgggacauaugauuacccucaauauagcgaagaggcgcggcuuaagagagaagagaucuccggagugaagcuggagagcauuggcaccuaccagauccucucuauuuauuccacagucgccagcucucuggcucuggccaucaugguggccgggcucucccuguggaugugcagcaauggcucccuucagugccgcaucuguauuuga

SEQ ID NO: 185506 - RNA, 1704 nt, Artificial Sequence
  derived and/or modified sequence opt5 from hemagglutinin__InfluenzaA__ACJ68609
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagcuccggcgugagcucugcuuguccuuaccaggggacccccuccuuuuuccgcaauguuguguggcugaucaaaaagaacaauacauauccuaccauuaaaagaagcuacaacaauacaaaccaagaggaccuccugauccuuuggggaauccaccacucuaacgaugccgcugagcagaccaagcuguaucagaauccgacgaccuacauuuccgucggcacaagcacccucaaccagcggcuggugcccaagaucgccacacgcucuaaagugaauggccaauccgggagaauggacuuuuucuggaccauucugaagccuaacgaugcgaucaauuuugaaagcaacggaaauuucauugcccccgaguacgcuuauaaaaucgucaagaaaggcgacuccgccaucaugaagucugaaguugaguacgggaacugcaauacgaaaugucagacaccuauuggagcuaucaacagcuccaugcccuuucauaauauucacccgcucaccaucggcgaaugcccuaaguaugugaaaagcaacaaacuggugcuugccacagggcugcgcaauucuccccuccgggagagacggcgcaagagaggacuguucggcgcgauugccggcuuuaucgaagggggauggcagggcauggucgacgggugguacggauaucaucacuccaacgaacagggcagcggguacgcugccgauaaagagucuacccaaaaggcuaucgacggagugaccaauaaaguuaacagcauuaucgauaagaugaacacacaguucgaagccgugggccgggaguuuaauaaccuugaacgcagaauugagaaucugaacaagaaaauggaggacggcuuccucgaugucuggacguauaaugccgaacugcuggugcucauggagaacgaacggacccuggacuuccacgauuccaauguuaagaaccuuuacgacaaagugcgccugcagcucagagauaaugcuaaggagcuggggaacggauguuuugaguucuaccauaaaugcgacaaugaguguauggagucuguccggaacggcacauaugauuacccucaauauagcgaagaggcgagacuucgccgggaagagaucuccggggugaagcuggagagcauuggaaccuaccagauccucucuauuuauuccacagucgccagcucucuggcucuggccaucaugguggccggccucucccuguggaugugcagcaaugggucccuucagugcagaaucuguauuuga

SEQ ID NO: 185507 - RNA, 1704 nt, Artificial Sequence
  derived and/or modified sequence opt5 from hemagglutinin__InfluenzaA__ACJ68610
auggagaagaucgugcuguuccucgccauugucagccugguuaaguccgaccagaucugcauuggcuaccacgcuaacaauucuaccgaacaaguggauacaaucauggagaagaacgugacggucacccaugcccaggacauucuugagaaaacacacaaugggaagcugugugaucucgacggagugaaaccccugauccuuagagauugcagcguugcgggcuggcugcucgggaacccuaugugugacgaguuuaucaaugugccggaaugguccuauauugucgagaaggcuaaccccgccaaugaucugugcuacccuggaaacuucaaugacuaugaggaacugaagcaucuccugucucggaucaaccacuuugagaaaauucagaucauucccaagagcuccuggucugaucaugaagccagcuccggcgugagcucugcuuguccuuaccaggggacccccuccuucuuucgcaauguuguguggcuuaucaaaaagaacaauacauauccuaccauuaaaagaagcuacaacaauacaaaccaagaggaccugcucauccuguggggaauccaccacucuaacgaugccgcugagcagaccaaacuuuaucagaauccgacgaccuacauuuccgucggcacaagcacccugaaccagcggcucgugcccaagaucgccacacgcucuaaggugaauggccaauccgggagaauggacuucuuuuggaccauucugaagccuaacgaugcgaucaauuucgaaagcaacggaaauuuuauugcccccgaguacgcuuauaaaaucgucaagaaaggcgacuccgccaucauuaagucugaaguugaguacgggaacugcaauacgaaaugucagacaccuaucggagcuauuaacagcuccaugcccuuccauaauauccacccgcugaccauuggcgaaugcccuaaguaugugaagucuaacaaacucgugcuggccacagggcuucggaauagcccccugcgcgagagacggcgcaagagaggacucuuuggcgcgaucgccggcuucaucgaagggggauggcagggcauggucgacgggugguacggauaucaucacuccaacgaacagggcagcggguacgcugccgauaaagagucuacccaaaaggcuauugacggagugaccaauaaaguuaacagcaucauugauaagaugaacacacaguuugaagccgugggccgggaguucaauaaccuggaacgcagaaucgagaaucuuaacaagaaaauggaggacggcuuccuggaugucuggacguauaaugccgaacuccuggugcugauggagaacgaacggacccucgacuuucacgauuccaauguuaagaaccuguacgacaaagugcgccuucagcugagagauaaugcuaaggagcucgggaacggauguuucgaauuuuaccauaaaugcgacaaugaguguauggagucuguccggaacggcacauaugauuacccucaauauagcgaagaggcgagacugaagcgcgaagagauuuccggggugaaacuugagagcaucggaaccuaccagauucugucuaucuauuccacagucgccagcucucucgcucuggccaucaugguggccggccugucccucuggaugugcagcaaugggucccugcagugccggauuuguaucuga

SEQ ID NO: 185508 - RNA, 1704 nt, Artificial Sequence
  derived and/or modified sequence opt5 from hemagglutinin__InfluenzaA__ACJ68611
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggucugaucaugaagccagccugggcguguccagcgcuuguccuuaccaggggaugcccuccuuuuuccgcaauguuguguggcucaucaaaaagaacaauaccuauccuacaauuaaaagaucuuacaacaauaccaaccaagaggaccugcuuauccuguggggaauccaccacagcaacgaugccgcugagcagacaaagcucuaucagaauccgaccacguacauuucugucggcaccuccacacugaaccagcggcuggugcccaagaucgccacccgcagcaaagugaauggccaaucugggagaauggacuuuuucuggacaauucucaagccuaacgaugcgaucaauuuugaauccaacggaaauuucauugcccccgaguacgcuuauaaaaucgucaagaaaggcgacagcgccaucaugaaguccgaaguuggguacggaaacugcaauaccaaaugucagacgccuauuggcgcuaucaacucuagcaugcccuuucauaauauucacccgcugacaaucggggagugcccuaaguaugugaaguccaacaaacuugugcuggccaccggacuccggaauagcccccugcgcgaaagacggcgcaagagaggccuuuucggcgcgauugccggguuuaucgagggaggcuggcaggggauggucgacggaugguacggcuaucaucacucuaacgagcagggguccggauacgcugccgauaaagaaagcacacaaaaggcuaucgacggcgugaccaauaaaguuaacucuauuaucgauaagaugaacacccaguucgaggccgugggccgggaauuuaauaaccuggagcgcagaauugaaaaucucaacaagaaaauggaggacggguuccuggaugucuggacauauaaugccgagcugcucgugcugauggaaaacgagcggacgcuugacuuccacgauagcaauguuaagaaccuguacgacaaagugcgccuccagcugagagauaaugcuaaggaacuuggaaacggcuguuuugaguucuaccauaaaugcgacgaugaauguauggaguccguccggaaugggaccuaugacuacccucaauauucugaggaagcgagacugaagcgcgaggaaaucagcggagugaagcucgaguccauuggcacauaccagauccugagcauuuauucuaccgucgccuccagccuggcucucgccaucaugguggccgggcugucucuuuggaugugcuccaacggcagccugcagugccggaucuguauuuga

SEQ ID NO: 185509 - RNA, 1704 nt, Artificial Sequence
  derived and/or modified sequence opt5 from hemagglutinin__InfluenzaA__ACJ68612
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucugugaucuggacggagugaaaccccuuauccugagagauugcagcguugcgggcuggcuccuggggaacccuaugugugacgaguucaucaaugugccggaaugguccuauauugucgagaaggcuaaccccgccaaugaucugugcuacccuggaaacuuuaaugacuaugaggaacucaagcaucugcuuucucggaucaaccacuucgagaaaauucagaucauucccaagagcuccuggccugaucaugaagccucuagcggcguguccagcgcuugucccuaccaggggaccccuucuuucuuccgcaauguuguguggcugaucaaaaagaacaauacauauccgaccauuaaaagauccuacaacaauacaaaccaagaggaccuccugauccuuuggggaauccaccacagcaacaaugccgcugagcagaccaagcuguaucagaaccccacgaccuacauuucugucggcacauccacccucaaucugcggcuggugccuaagaucgccacacgcagcaaagugaacggccagucugggagaauggacuuuuucuggaccauucucaagcccaaugaugcgaucaacuuugaauccaauggaaacuucauugccccugaguacgcuuauaaaaucgucaagaaaggcgauagcgccaucaugaaguccgaaguugaguacgggaauugcaacacgaaaugucaaacacccauuggagcuaucaauucuagcaugccguuucauaacauucacccucugaccaucggcgaaugccccaaguaugugaaguccaauaaacuugugcuggccacagggcuccggaacagcccucugcgcgagagacggcgcaagagaggacuuuucggcgcgauugccggcuuuaucgaagggggauggcagggcauggucgacgggugguacggauaucaucacucuaaugaacagggcuccggguacgcugccgacaaagagagcacccagaaggcuaucgauggagugaccaacaaaguuaacucuauuaucgacaagaugaauacacaauucgaagccgugggccgggaguuuaacaaucuggaacgcagaauugagaaccucaauaagaaaauggaggauggcuuccuggacgucuggacguauaacgccgaacugcucgugcugauggagaaugaacggacccuugauuuccacgacagcaacguuaagaaucuguacgauaaagugcgccuccagcugagagacaacgcuaaggagcuugggaauggauguuuugaauuuuaccauaaaugcgauaacgaguguauggaguccguccggaauggcacauaugacuacccccaguauucugaagaggcgagacugaagcgcgaagagaucagcggggugaagcucgaguccauuggagccuaccaaauccugagcauuuauucuaccgucgcuuccagccuggcccucgccaucaugguggcuggccugucucuuuggaugugcuccaacgggagccugcagugccggaucuguauuuga

SEQ ID NO: 185510 - RNA, 1704 nt, Artificial Sequence
  derived and/or modified sequence opt5 from hemagglutinin__InfluenzaA__ACJ68613
auggagaagaucgugcuguuccucgccauugucagccacguuaaauccgaccagaucugcauuggcuaccaugcuaacaauucuaccgaacaaguggauacaaucauggagaagaacgugacggucacccacgcccaggacauucuggaaaagacacauaaugggaaacuuugugaucugggaggcgugaaaccccucauccugagagacugcagcguugcgggguggcuucugggaaacccuaugugugaugaguuuaucaaugugccggaaugguccuauauugucgagaaggcuaaccccgccaaugaccucugcuacccuggcaacuucaaugauuaugaggaacugaagcaucugcucucucggaucaaccacuuugagaaaauucagaucauucccaagagcuccuggucugaccacgaagccagcuccggggugagcucuguuuguccuuaccagggaacccccuccuucuuucgcaauguggucuggcugaucaaaaagaacaauacauauccuaccauuaaaaagagcuacaacaauacaaaccaagaggaucuucugauccucuggggcauccaccauucuaacgacgcugccgagcagaccaagcuguaucagaauccgacgaccuacauuuccgugggcacaagcacccuuaaccagagacuggugcccaaaaucgcuacacggucuaaggucaaugggcaauccggacgcauggauuucuuuuggaccauucucaaaccuaacgacgccaucaauuucgaaagcaacggcaauuuuauugcgcccgaguacgccuauaagaucguuaaaaagggggauuccgcuaucaugaaaucugaaguggaguacggaaacugcaauacgaagugucagacaccuauuggcgccaucaacagcuccaugcccuuccacaauauucauccgcugaccaucggggaaugcccuaaguaugugaaaagcaacaagcugguccucgcuacaggacugagaaauucuccccuucgggagcgcagacggaaacgcggccuguuuggcgccauugcgggguucaucgagggaggcuggcaggggaugguggacggaugguacggcuaucaccacuccaacgaacaggggagcggauacgccgcugacaaggagucuacccaaaaagccaucgauggcguuaccaauaaggugaacagcauuaucgacaagaugaacacacaguuugaagcugucggcagagaguucaauaaccucgaacggcgcauugagaaucugaacaaaaagauggaggauggguuccuugacguguggacguauaaugccgaacugcucguucugauggagaacgaaagaacccuggauuuucaugacuccaaugugaaaaaccucuacgauaagguccggcugcagcuucgcgacaaugccaaagagcugggaaacggcuguuucgaauuuuaccacaagugcgauaaugaguguauggagucugugagaaacgggacauaugacuacccucaauauagcgaagaggcucggcucaagagagaagagaucuccggagucaaacuggagagcauuggcaccuaccagauccuuucuauuuauuccacaguggcgagcucucuggcccucgcuaucaugguugccgggcugucccuguggaugugcagcaauggcucccuccagugccgcaucuguauuuga

SEQ ID NO: 185511 - RNA, 1707 nt, Artificial Sequence
  derived and/or modified sequence opt5 from hemagglutinin__InfluenzaA__ACJ68614
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgugaaugaucucugcuacccuggaaacuuuaaugacuaugaggaacugaagcaucuucugucucggaucaaccacuucgagaaaauucagaucauucccaagagcuccuggucugaucaugaagcuagcuccggcguuagcucugccuguccuuaccaggggcgcuccagcuuuuucagaaauguggucuggcucaucaaaaagaacaauaccuaucccacaauuaaacggucuuacaacaauaccaaccaagaggaccugcuugugcuguggggaauccaccacccuaacgaugccgcugagcagacacgccucuaucagaauccgaccacguacaucuccgugggcaccagcacacugaaccagagacugguccccaagcucgccacccggucuaagguuaauggccaauccgggcgcauggaauuuuucuggacaauucugaaaccuaacgacgcuaucaauuuugagagcaacggaaauuucauugcccccgaaaacgcguacaagaucgugaaaaagggcgauuccaccauuaugaaaucugagcuugaauaugggaauugcaacacgaagugucagacaccuaucggagccaucaauagcuccaugcccuuucauaacauucacccgcugaccaucggcgagugcccuaaauacgugaaaagcaauagacucguccuggcuacagggcuucggaacucuccccagggagagcgcagacggaagaaacgcggccuguucggcgccauugcuggguuuaucgaaggaggcuggcaggggaugguggacggaugguauggcuaccaucacuccaaugagagagggagcggauaugccgcggacaaggaaucuacccaaaaagccauugauggcguuaccaacaaggugaacagcaucaucgacaaaaugaauacacaguucgaggcugucggccgggaauuuaacaaucucgagcgcagaauugagaaccugaauaagaagauggaagauggguuccuggacguguggacguacaacgccgagcuccugguucuuauggaaaaugagcggacccuggauuuccacgacuccaacgugaaaaaucucuaugauaaggucagacugcagcuucgcgacaacgcuaaagaacugggaaauggcuguuuugaguucuaccaucggugcgauaacgaguguauggaaucugugagaaaugggacauacgacuauccucaauacagcgaggaagcccgccucaagcgggaggagaucuccggagucaaacuggaaagcauuggcaccuaucagauccugucuauuuacuccacaguggccagcucucucgcucuggcgaucaugguugccgggcuuucccuguggaugugcagcaacggcucccuccagugcagaauuuguaucuga

SEQ ID NO: 185512 - RNA, 1698 nt, Artificial Sequence
  derived and/or modified sequence opt5 from hemagglutinin__InfluenzaA__ACK99007
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagucucagcugaagaacaaugccaaagagauuggcaacgggugcuucgaguuuuaccacaaguguaaugaugaaugcauggaguccgugaaaaacggcacauaugacuaccccaaguauagcgaagagucuaaacucaaucgggagaagaucgauggaguuaagcuggaauccaugggcguguaccagauucuggcuaucuauagcaccgucgccuccucucucgugcugcuuguuagccugggggccaucuccuucuggaugugcucuaacggaagccuccagugucgcauuugcaucuga

SEQ ID NO: 185513 - RNA, 1698 nt, Artificial Sequence
  derived and/or modified sequence opt5 from hemagglutinin__InfluenzaA__ACK99008
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagucucagcugaagaacaaugccaaagagauuggcaacgggugcuucgaguuuuaccacaaguguaaugaugaaugcauggaguccgugaaaaacggcacauaugacuaccccaaguauagcgaagagucuaaacucaaucgggagaagaucgauggaguuaagcuggaauccauggagguguaccagauucuggcuaucuauagcaccgucgccuccucucucgugcugcuuguuagccugggcgccaucuccuucuggaugugcucuaacgggagccuccagugucgcauuugcaucuga

SEQ ID NO: 185514 - RNA, 1698 nt, Artificial Sequence
  derived and/or modified sequence opt5 from hemagglutinin__InfluenzaA__ACK99009
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuacauuugaagcgaauggcaaccucaucgccccucgguacgcuuucgcccugucccgcggguuuggaagcggcauuaucaauucuaacgcucccauggauaagugugacgccaaaugccagaccccgcaaggcgcgauuaauuccagccuuccuuuccagaacgugcaucccgucacaaucggggaguguccuaaguaugugagaucugccaaacugcggaugguuaccggacuccgcaauauccccagcauucaguccagaggccuguuuggggcuaucgccggauucauugaaggcggguggaccggaaugguggauggcugguacggcuaucaccaccagaacgagcaagggucuggauacgcugccgaccaaaagagcacacagaaugccaucaacggcauuacgaauaaagucaacuccgugaucgaaaagaugaauacccaguuuacagcuguugggaaggaguucaacaaacuggagcggcgcauggaaaaccucaauaagaaaguggaugacggauucaucgauauuuggaccuacaacgcggagcugcuuguccugcucgaaaaugagagaacacuggacuuucaugacagcaacgugaagaaucuuuaugaaaaagucaagucucagcugaagaacaaugccaaagagaucggcaacgggugcuucgaguuuuaccacaaguguaaugaugaaugcauggaguccgugaaaaacggcaccuaugacuaccccaaguauagcgaagagucuaaacucaaucgggagaagauugauggaguuaagcuggaauccaugggcguguaccagauccuggcuauuuauagcacggucgccuccucucucgugcugcuuguuagccugggggccaucuccuucuggaugugcucuaacggaagccuccagugucgcaucugcauuuga

SEQ ID NO: 185515 - RNA, 1698 nt, Artificial Sequence; identical to SEQ ID NO: 185512
  derived and/or modified sequence opt5 from hemagglutinin__InfluenzaA__ACK99011

SEQ ID NO: 185516 - RNA, 1698 nt, Artificial Sequence
  derived and/or modified sequence opt5 from hemagglutinin__InfluenzaA__ACK99012
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagucucagcugaagaacaaugccaaagagauuggcaacgggugcuucgaguuuuaccacaaguguaaugaugaaugcauggaguccgugaaaaacggcacauaugacuaccccaaguauagcgaagagucuaaacucaaucgggagaagaucgauggaguuaagcuggaauccaugggcguguaccagauucuggcuaucuauagcaccgucgccuccucucucgugcugcuuaucagccugggggccauuuccuucuggaugugcucuaacggaagccuccagugucgcaucugcauuuga

SEQ ID NO: 185517 - RNA, 1698 nt, Artificial Sequence; identical to SEQ ID NO: 185512
  derived and/or modified sequence opt5 from hemagglutinin__InfluenzaA__ACK99013

SEQ ID NO: 185518 - RNA, 1698 nt, Artificial Sequence
  derived and/or modified sequence opt5 from hemagglutinin__InfluenzaA__ACK99014
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucacacugucccgcggguuuggaagcggcaucauuaauucuaacgcccccauggauaagugugacgcuaaaugccagaccccgcaaggcgccaucaauuccagccuuccuuuccagaacgugcaucccgucacaaucggggaguguccuaaguaugugagaucugcgaaacugcggaugguuaccggacuccgcaauauucccagcauccaguccagaggccuguuuggggccauugcuggauucaucgaaggcggguggaccggaaugguggauggcugguacggcuaucaccaccagaacgagcaagggucuggauacgccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucaugacagcaacgugaagaaucuuuaugaaaaagucaagucucagcugaagaacaaugcgaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacggucgcuuccucucucgugcugcuuguuagccugggggccaucuccuucuggaugugcucuaacggaagccuccagugucgcauuugcaucuga

SEQ ID NO: 185519 - RNA, 1698 nt, Artificial Sequence; identical to SEQ ID NO: 185512
  derived and/or modified sequence opt5 from hemagglutinin__InfluenzaA__ACK99016

SEQ ID NO: 185520 - RNA, 1698 nt, Artificial Sequence; identical to SEQ ID NO: 185512
  derived and/or modified sequence opt5 from hemagglutinin__InfluenzaA__ACK99018

SEQ ID NO: 185521 - RNA, 1698 nt, Artificial Sequence; identical to SEQ ID NO: 185512
  derived and/or modified sequence opt5 from hemagglutinin__InfluenzaA__ACK99023

SEQ ID NO: 185522 - RNA, 1698 nt, Artificial Sequence
  derived and/or modified sequence opt5 from hemagglutinin__InfluenzaA__ACK99026
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccaucaccauuggggaguguccuaaguaugucagaucugccaaacugcggauggugacaggacuccgcaauauccccagcauucaguccagaggccuguuuggggcuaucgccggauucauugaaggcggguggaccggaaugguugauggcugguacggcuaucaccaccagaacgagcaagggucuggauacgcugccgaccaaaagagcacccagaaugccaucaacggcaucacaaauaaagugaacuccgucauugaaaagaugaauacgcaguuuaccgcuguggggaaggaguucaacaaacuggagcggcgcauggaaaaccucaauaagaaaguugaugacggauucaucgauauuuggacauacaacgcggagcugcuugugcugcucgaaaaugagagaacccuggacuuucaugacagcaacgucaagaaucuuuaugaaaaagugaagucucagcugaagaacaaugccaaagagaucggcaacgggugcuucgaguuuuaccacaaguguaaugaugaaugcauggaguccgucaaaaacggcacauaugacuaccccaaguauagcgaagagucuaaacucaaucgggagaagauugauggagugaagcuggaauccaugggcguuuaccagauccuggcuaucuauagcaccguggccuccucucucguccugcuugugagccugggggccauuuccuucuggaugugcucuaacggaagccuccagugucgcaucugcauuuga

SEQ ID NO: 185523 - RNA, 1698 nt, Artificial Sequence; identical to SEQ ID NO: 185196
  derived and/or modified sequence opt5 from hemagglutinin__InfluenzaA__ACK99027

SEQ ID NO: 185524 - RNA, 1698 nt, Artificial Sequence
  derived and/or modified sequence opt5 from hemagglutinin__InfluenzaA__ACK99028
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgaagggcgcgaucaauuccagccuuccuuuccaaaacgugcaucccgucaccaucggggaguguccuaaauaugugagaucugccaagcugcggaugguuacaggacuccgcaauauucccagcauccaguccagaggccuguuuggggcuauugccggauucaucgaaggcggguggaccggaaugguggauggcugguacggcuaucaccaccagaacgagcaggggucuggauacgcugccgaccagaaaagcacccaaaaugccauuaacggcaucacaaauaaggucaacuccgugaucgaaaagaugaauacgcaguuuaccgcuguugggaaagaguucaacaagcuggagcggcgcauggaaaaccucaauaaaaagguggaugacggauucauugauaucuggacauacaacgcggagcugcuuguccugcucgaaaaugagagaacccuggacuuucaugacagcaacgugaaaaaucuuuaugaaaaggucaagucucagcugaaaaacaaugccaaggagauuggcaacgggugcuucgaguuuuaccacaaauguaaugaugaaugcauggaguccgugaagaacggcacauaugacuaccccaaauauagcgaagagucuaagcucaaucgggagaagaucgauggaguuaaacuggaauccaugggcguguaccaaauucuggcuaucuauagcaccgucgccuccucucucgugcugcuuguuagccugggggccaucuccuucuggaugugcucuaacggaagccuccagugucgcauuugcaucuga

SEQ ID NO: 185525 - RNA, 1698 nt, Artificial Sequence
  derived and/or modified sequence opt5 from hemagglutinin__InfluenzaA__ACK99029
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauuuccaagcggccuaaagugcgcgaucaggaggggagaaucaacuacuauuggacccuucuggagcccggagacacgauuaucuuugaagccaauggcaaccucauugcgccucgguacgccuucgcucugagccgcggguuuggaucuggcaucauuaauuccaacgcccccauggauaagugugacgcuaaaugccagacaccgcaaggcgccaucaauagcucucuuccuuuccagaacgugcaucccgucaccaucggggaguguccuaaguaugugagaagcgcgaaacugcggaugguuacaggacuccgcaauauucccuccauccagucuagaggccuguuuggggccauugcuggauucaucgaaggcggguggaccggaaugguggauggcugguacggcuaucaccaccagaacgagcaagggagcggauacgccgcugaccagaaguccacccagaaugccauuaacggcaucacaaauaaagucaacagcgugaucgaaaagaugaauacgcaguuuaccgccguugggaaggaguucaacaaacuggagcggcgcauggaaaaccucaauaagaaaguggaugacggauucauugauaucuggacauacaacgcugagcugcuuguccugcucgaaaaugagagaacccuggacuuucaugacucuaacgugaagaaucuuuaugaaaaagucaagucccaacugaagaacaaugcgaaagagauuggcaacgggugcuucgaguuuuaccacaaguguaaugaugaaugcauggagagcgugaaaaacggcacauaugacuaccccaaguauucugaagaguccaaacucaaucgggagaagaucgauggaguuaagcuggaaagcaugggcguguaccagauucuggccaucuauuccaccgucgcuucuagccucgugcugcuuguuucccugggggccaucucuuucuggaugugcagcaacggaucccuccagugucgcauuugcaucuga

SEQ ID NO: 185526 - RNA, 1698 nt, Artificial Sequence; identical to SEQ ID NO: 185512
  derived and/or modified sequence opt5 from hemagglutinin__InfluenzaA__ACK99030

SEQ ID NO: 185527 - RNA, 1698 nt, Artificial Sequence; identical to SEQ ID NO: 185512
  derived and/or modified sequence opt5 from hemagglutinin__InfluenzaA__ACK99031

SEQ ID NO: 185528 - RNA, 1698 nt, Artificial Sequence; identical to SEQ ID NO: 185512
  derived and/or modified sequence opt5 from hemagglutinin__InfluenzaA__ACK99032

SEQ ID NO: 185529 - RNA, 1698 nt, Artificial Sequence; identical to SEQ ID NO: 185512
  derived and/or modified sequence opt5 from hemagglutinin__InfluenzaA__ACK99033

SEQ ID NO: 185530 - RNA, 1698 nt, Artificial Sequence
  derived and/or modified sequence opt5 from hemagglutinin__InfluenzaA__ACK99034
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcgauuuugggagcggaaucauuaauucuaacgcucccauggacaagugugaugccaaaugccagacaccgcaaggcgcgaucaauuccagccuuccuuuccagaacgugcaucccgucaccaucggcgaguguccuaaguaugugagaucugccaaacugcggaugguuacagggcuccgcaauauucccagcauccaguccagaggacuguuuggcgcuauugccggguucaucgaaggaggcuggaccgggaugguggacggaugguacggcuaucaccaccagaacgagcaaggcucuggguacgcugccgaucaaaagagcacccagaaugccauuaacggaaucacaaauaaagucaacuccgugaucgaaaagaugaauacgcaguuuaccgcuguuggcaaggaguucaacaaacuggagcggcgcauggaaaaccucaauaagaaaguggacgauggguucauugacaucuggacauacaacgcggagcugcuuguccugcucgaaaaugagagaacccuggacuuucaugauagcaacgugaagaaucuuuaugaaaaagucaagucucagcugaagaacaaugccaaagagauuggaaacggcugcuucgaguuuuaccacaaguguaaugacgaaugcauggaguccgugaaaaacgggacauaugauuaccccaaguauagcgaagagucuaaacucaaucgggagaagaucgacggcguuaagcuggaauccaugggaguguaccagauucuggcuaucuauagcaccgucgccuccucucucgugcugcuuguuagccugggcgccaucuccuucuggaugugcucuaacgggagccuccagugucgcauuugcaucuga

SEQ ID NO: 185531 - RNA, 1698 nt, Artificial Sequence
  derived and/or modified sequence opt5 from hemagglutinin__InfluenzaA__ACK99035
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcgccuucgaacgguuugagaucuuccccaaggaguccagcuggccuaaccacacggugaccggaguuucugcuuccugcagccauaauggcgaaucuuccuuuuaucgcaaccugcuuuggcugacaggcaaaaaugggcucuaccccaaccugagcaagucuuaugccaauaacaaagagaaggaagugcugguccucuggggagugcaccacccuccgaacaucggcgaccagaaagcucuguaccauaccgagaaugccuacguguccgucguuagcucccacuauucuagaaaguucacacccgaaauuagcaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacacacccauggauaagugugacgcuaaaugccagaccccgcaaggcgccaucaauuccagccuuccuuuccagaacgugcaucccgucacaaucggggaguguccuaaguaugugagaucugcgaaacugcggaugguuaccggacuccgcaauauucccagcauccaguccagaggccuguuuggggccauugcuggauucaucgaaggcggguggaccggaaugguggauggcugguacggcuaucaccaccagaacgagcaagggucuggauacgccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucaugacagcaacgugaagaaucuuuaugaaaaagucaagucucagcugaagaacaaugcgaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacggucgcuuccucucucgugcugcuuguuagccugggggccaucuccuucuggaugugcucuaacggaagccuccagugucgcauuugcaucuga

SEQ ID NO: 185532 - RNA, 1701 nt, Artificial Sequence; identical to SEQ ID NO: 185362
  derived and/or modified sequence opt5 from hemagglutinin__InfluenzaA__ACK99421

SEQ ID NO: 185533 - RNA, 1689 nt, Artificial Sequence
  derived and/or modified sequence opt5 from hemagglutinin__InfluenzaA__ACK99432
auggccaucauuuaccugauccuccuguucaccgcugugagaggcgaccagauuugcaucggguaucacgccaacaauagcacagagaagauugauacgauccuugaacggaacgucaccguuacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacauuauggagaaagagaacccucgguauagccugugcuaccccggguccuuuaaugauuaugaagaacuuaagcaucugcucucuagcgugaagcacuucgaaaaagucaagauccugccuaaagaccgcuggacacaacauaccacaaccggaggcuccauggccugugccgugucuggcaagcccagcuuuuucagaaacaugguuuggcuuacgaccaaagggccuaauuacccgguggcucagggauccuauaacaauacaagcggcgagcagaugcugauuaucuggggaguccaccaccccaacgaugaggccgaacagcgggcucucuaccaaaagguggggaccuacguuucugccuccacaagcacccuguauaagcgcucuauuccugagaucgcggccagacccaaagugaauggccuggggucccggauggaauuuagcuggacgcuccuggacaugugggauacaaucaacuucgagucuaccggaaaucuugucgcuccugaauacggcuuuaagauuuccaaacgcggcagcuccgggaucaugaagacagagggaacccuggagaacugcgaaaccaaaugucagacaccccucggcgccauuaacacgacccugccguuccauaaugugcacccucuuacaaucggggagugccccaaguaugugaaaucugaaaagcugguccucgcuaccggacugagaaacguuccucagauugagagccggggccuguuuggggccaucgcgggauucaucgaaggcggcuggcaggggaugguggacggaugguacggcuaucaucacuccaaugaucaagggagcggauacgccgcugacaaggagucuacacagaaagccuuugauggcauuaccaacaaggucaauuccgugaucgagaaaaugaacacgcaguucgaagcuguggggaaggaguuuagcaaucucgaaaaacgccuggagaaccuuaauaagaagauggaagacggcuuccuggacguuuggacauauaacgccgagcuccuggugcuuauggagaaugaaagaacccuggauuuccacgacucuaacgucaaaaaucucuacgauaaggugcggaugcagcugcgcgacaacguuaaagagcugggaaauggcuguuuugaguucuaccauaagugcgauaacgaguguauggacagcgugaaaaacgggaccuaugauuaccccaaguaugaggaagaguccaagcucaauagaaacgaaauuaaaggagucaagcugucuagcaugggcguguaccaaauccuugccauuuaugcuacagucgcggggucccugagccucgccaucaugauggcuggaaucucuuuuuggaugugcuccaauggcagccugcagugccggauuuguaucuga

SEQ ID NO: 185534 - RNA, 1701 nt, Artificial Sequence
  derived and/or modified sequence opt5 from hemagglutinin__InfluenzaA__ACK99443
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaagagagcugguccuauauugcugaaacacccaauucugagaacggcaccuguuaccccggguauuucgccgauuacgaggaacugcgggagcaacuuagcuccgugagcucuuuugaacgcuucgagaucuuuccuaaggaguccagcuggcccaaucauacgguuaccaagggagugacagcugccugcucucacaacggcaaauccagcuucuauagaaaucugcucuggcugaccgaaaagaacggccuuuacccuaaucugucuaaauccuaugucaacaauaaggagaaagaagugcucguucuguggggagugcaucaccccagcaacaucggggaccagcgggcgauuuaccacacagagaacgccuacgucuccguggugucuagccauuauucccgcagauuuaccccugaaaucgcuaagcggccgaagguccgcggccaggaggggagaauuaauuacuauuggacgcugcucgagcccggagauacaaucauuuucgaagccaacggcaaucugaucgcuccuugguacgccuuugcgcuuagccggggguucggaucuggcauuaucaccuccaacgccagcauggacgagugugaugcuaaaugccagacaccccaaggcgccaucaauucuagccugccuuuucagaacguucaccccgugaccauuggggaauguccgaaguaugugcgcuccaccaaacucagaauggucacaggacugcggaauaucccuucugugcagagccgcggccuuuucggggcuauugccggauuuaucgagggcggguggacgggaaugauugacggcugguacggcuaucaucaccagaacgaacaaggguccggauacgccgcugaucaaaagagcacccagaaugcgaucaacggcaucacaaauaaaguuaacucugugauugagaagaugaauacccaguucacagccgucgggaaagaguucaacaagcuggaaagacggauggagaaucucaacaagaaaguggacgauggauuucuggacaucuggaccuacaacgcugaacugcucguucugcuugagaaugaacgcacgcuggacuuccacgauuccaacgugaagaaucucuaugagaaagucaagagccagcugaaaaacaaugccaaggagauuggcaacgggugcuuugaguucuaccauaaguguaauaacgaaugcauggaaucugugaaaaauggcacauaugacuaccccaaguauuccgaggagagcaaacuuaacagagaaaagaucgauggagucaaacuggaguccaugggcguguaccagauucucgccaucuauucuaccguugcuagcucccuggugcugcucgucucucugggggccaucagcuuuuggaugugcuccaauggaagccuucagugucggauuugcaucuga

SEQ ID NO: 185535 - RNA, 1701 nt, Artificial Sequence
  derived and/or modified sequence opt5 from hemagglutinin__InfluenzaA__ACK99465
augaaggccaaacugcucgugcugcuuugcgcuuucaccgccacauacgcggacacgaucuguauuggcuaucacgcuaacaauagcaccgauacagucgacaccguucuggagaagaacgugacagugacccauuccgucaaucuccuggaagauucucacaacgggaaacuuugcagacugaagggaacagcuccccuccagcugggcaauuguagcguggccggguggauccugggaaacccugagugcgaaucccucuuuucuaaagagagcugguccuacauugccgaaaagccgaaucccgagaacggcaccuguuauccuggguacuucgccgacuaugaggaacugcgggagcaacuuucuagcguuuccagcuuugaacgcuucgagaucuuucccaaggagucuuccuggccuaaucauacggugaccaaaggagucacagcuagcugcucucacaacggcaaguccagcuucuacaaaaaucugcucuggcugaccaagaaaaacggccuuuaucccaaucugucuaaguccuacgugaacaauaaggaaaaagagguucucgugcuguggggaguccaucacccuagcaacauuggggaucagagagccaucuaccacacagaaaacgcguauguguccguggucucuagccauuacucccggcgcuuuaccccggagaucgccaagagacccaaaguucgggaccaggaaggccgcauuaauuauuacuggacgcugcucgagccuggggauacaaucauuuucgaggcuaacggaaaucugaucgcccccugguaugcuuuugcccuuagcagaggcuucgggucuggaauuaucaccuccaacgcgagcaugggcgaaugugacgccaagugccagacaccucaaggcgcuauuaauucuagccugcccuuucagaacgugcacccggugaccaucggggaguguccuaaauacguccgguccaccaagcuccgcauggugacaggacugagaaauauccccucuauucagagccggggccuuuucggggccaucgcuggauuuauugaaggcggguggacgggaaugaucgauggcugguauggcuaccaucaccagaacgagcaaggguccggauacgccgccgacaaaaagagcacccagaaugcuauugauggcaucacaaacaagguuaauucugugaucgaaaagaugaacacccaguucacagcggucgggaaggaguucaauaaacuggagcgcagaauggaaaaccucaauaagaaaguggacgauggauuucuggacauuuggaccuauaacgccgagcugcucguucugcuugaaaacgagcggacgcuggacuuccacgauuccaaugugaagaaccucuacgaaaaggucaaaaaucagcugaagaacaaugcuaaagagaucggcaacgggugcuuugaguucuaucauaaguguaauaacgaaugcauggagagcgugaaaaauggcacauacgacuauccuaaguacucugaagaguccaaacuuaaacgcgagaagauugauggagucaaacuggaaagcaugggcguguaucaaauccucgccauuuacuccaccguugccucuagccuggugcugcucgucucccugggggcuaucucuuuuuggaugugcagcaacggaucccuucaguguagaaucugcauuuga

SEQ ID NO: 185536 - RNA, 1701 nt, Artificial Sequence
  derived and/or modified sequence opt5 from hemagglutinin__InfluenzaA__ACK99476
augaagaccaucauugcccugagcuacauccucugcaugguguucgcucagaaacugcccggcaacgacaauuccacagccacgcuuugucuggggcaccaugcggucccuaacggaacccucguuaagacaauuaccaaugaucaaaucgaggugacaaacgcuaccgaacuggugcagucuagcuccacaggcagaauuugcgacucuccgcaccggauccuugaugggaaaaauuguacccugaucgacgcccuccugggagauccccauugcgacgauuuucagaacaaggagugggaccuguucgucgaacgcagcaaagccuauuccaauuguuacccuuaugaugugcccgacuacgcuucucucagaagccugguugccuccagcggcacgcuugaguuuaacaaugaaucuuucaacuggaccgggguggcucagaauggaacauccuaugccugcaagcggcgcagcgucaagucuuucuucuccagacugaacuggcuccacaaacuggaguacaaguauccugcgcuuaaugugaccaugcccaacaaugauaaauuugacaagcuguacauuuggggcguucaucacccucggacagauagcgaccaaaccucucucuacgugcaggccuccggccgcgucacggugagcacaaaaagaucccagcagaccgugaucccgaacauugggucuagccccuggguccggggaguuuccagccgcaucucuauuuauuggacaaucgugaagccuggcgacauucugcugaucaacuccaccgggaaucucaucgcucccagaggauacuucaagauucggagcggcaaaucuagcaucaugcgcuccgaugccccuauugggaacuguaauucugagugcaucacccccaacggaagcauuccgaaugacaagccuuuucaaaacgugaauagaaucacauauggcgcuuguccccgguacgucaaacagaacacgcugaagcuggccaccggcaugcgcaaugugccugaaaaacagacaagagggaucuucggagcgauugccggcuuuaucgagaacgggugggaaggaaugguugauggcugguauggguuccggcaccaaaauuccgagggaaccggccaggcugccgaccuuaagagcacacaggcugccauuaaccagaucaauggcaaacucaacagacugauugagaagaccaaugaaaaguuucaucaaaucgagaaagaauuuucugagguggaagggcgcauccaggaucuugagaaguacgucgaggacacgaaaauugaucugugguccuauaacgccgaacuccugguggcucuggagaaccagcacacaaucgaccucaccgauagcgaaaugaauaagcuguucgagcggaccagaaaacagcuucgcgaaaacgcggaggacaugggaaauggcugcuuuaagauuuaccauaagugugauaacgccugcaucgggucuauucggaauggaacauacgaccacgacguuuauagagaugaggcucugaacaaucgcuuccaaaucaaaggcguggaacucaaguccggguacaaagacuggauucuguggaucagcuuugccaucuccugcuuccuucugugugucgugcuccugggcuuuauuaugugggccugccagaagggaaacauccgguguaauauuugcaucuga

SEQ ID NO: 185537 - RNA, 1698 nt, Artificial Sequence; identical to SEQ ID NO: 184938
  derived and/or modified sequence opt5 from hemagglutinin__InfluenzaA__ACL12063

SEQ ID NO: 185538 - RNA, 1701 nt, Artificial Sequence
  derived and/or modified sequence opt5 from hemagglutinin__InfluenzaA__ACL12129
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgggucuccgcaccggauccuggacgggaaaaauuguacccucaucgaugcccugcugggcgacccccauugcgauggguuucagaacaaggagugggaccucuucgucgaacgcagcaaagccuauuccaauuguuacccuuaugaugugcccgacuacgcuucucugagaagccuuguugccuccagcggaacgcuggaguuuauuaacgaagauuucaauuggaccggcguggcucaggacggcgggucuuaugccugcaagcggggauccgucaacagcuuuuucucucgccucaauuggcugcacaaacuugaguacaaguauccugcgcugaacgugacaaugcccaauaacggcaaguuugauaaacucuacaucuggggaguucaucacccuuccaccgacagcgaucaaacaucucuguacgugagagccuccggacgggucaccgugagcacgaagcgcucccagcagacagugaccccgaauauuggcucuagacccuggguccgggggcagagcucccgcaucagcauuuauuggacaaucguuaaaccuggagacauucugcucaucgacucuaccggcaaccugaucgcucccagaggcuacuucaagauucggaacgggaaguccagcaucaugcgcucugaugccccuauuggaaauuguagcuccgagugcaucacccccaacggcucuauuccgaaugacaaaccuuuucaaaacgugaauagaaucacauauggggcuuguccccgguacgugaagcagaacacgcuuaaacuggccaccggaaugcgcaaugucccugaaaagcagacaagaggcaucuucggggcgauugccggauuuaucgagaacggcugggaaggcaugguggaugggugguauggauuccggcaccagaauagcgagggcaccgggcaagcugccgaccucaaauccacacaggcugccauugaucagaucaacggaaagcugaauagacuuauugagaaaaccaacgaaaaguuucaacagaucgagaaggaguucagcgaaguugaaggccgcauccaggaccuggagaaauacguggaggauacgaagauugaccucuggucuuauaaugccgaacugcuggucgcucucgagaaccagcauacaaucgaucugaccgacuccgaaaugaauaaacuuuucgagaagacccggaaacaacugagagaaaacgcggaggauauggggaacggcugcuuuaagauuuaccacaagugugacaaugccugcaucggaagcauucgcaacggcacauacgaccaugauguguaucgggacgaggcucucaauaacagauuccagaucaaagggguugaacugaagucuggauacaaagauuggauucuuuggaucuccuuugccaucagcugcuuccugcucugugugguccugcugggcuuuauuaugugggccugccagaaggggaauauccgcuguaacauuugcaucuga

SEQ ID NO: 185539 - RNA, 1701 nt, Artificial Sequence; identical to SEQ ID NO: 185380
  derived and/or modified sequence opt5 from hemagglutinin__InfluenzaA__ACL12140

SEQ ID NO: 185540 - RNA, 1698 nt, Artificial Sequence; identical to SEQ ID NO: 185464
  derived and/or modified sequence opt5 from hemagglutinin__InfluenzaA__ACL12151

SEQ ID NO: 185541 - RNA, 1701 nt, Artificial Sequence; identical to SEQ ID NO: 185458
  derived and/or modified sequence opt5 from hemagglutinin__InfluenzaA__ACL12162

SEQ ID NO: 185542 - RNA, 1701 nt, Artificial Sequence
  derived and/or modified sequence opt5 from hemagglutinin__InfluenzaA__ACL12173
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauuaaucagaucaacgggaaacucaacagacugauuggaaagaccaaugaaaaauuccaccagaucgagaaggaauuuagcgagguggaaggccgcauucaagaucuugagaaguacgucgaggacacgaaaaucgaucugugguccuauaacgccgaacuccugguggcucuggagaaucagcauacaauugaccucaccgauagcgaaaugaacaagcuguucgagaaaaccaagaaacagcuucgggaaaaugcggaggacauggggaacggaugcuuuaagaucuaccacaagugugauaaugccugcaucggcucuauuagaaacgggacauaugaccaugauguuuaccgcgacgaggcucugaauaaccgguuccagaucaaaggcguggaacucaaguccggauacaaagacuggauucuguggaucagcuuugccauuucuugcuuccuucugugugucgcccuccugggcuuuaucaugugggcuugccaaaaggggaauaucagauguaacauuugcaucuga

SEQ ID NO: 185543 - RNA, 1701 nt, Artificial Sequence
  derived and/or modified sequence opt5 from hemagglutinin__InfluenzaA__ACL12184
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauauaaccaugauguuuaccgcgacgaggcucugaauaaccgguuccagaucaaaggcguggaacucaaguccggauacaaagacuggauucuguggaucagcuuugccauuucuugcuuccuucugugugucgcccuccugggcuuuaucaugugggcuugccaaaaggggaauaucagauguaacauuugcaucuga

SEQ ID NO: 185544 - RNA, 1701 nt, Artificial Sequence; identical to SEQ ID NO: 185458
  derived and/or modified sequence opt5 from hemagglutinin__InfluenzaA__ACL12195

SEQ ID NO: 185545 - RNA, 1701 nt, Artificial Sequence
  derived and/or modified sequence opt5 from hemagglutinin__InfluenzaA__ACL12217
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggaugugcugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugucaaccgcauuacguauggcgcuuguccuagauacguuaaacaaaauacccugaaacuugccacagggaugcggaacgugcccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgaggucgaaggccgcauccaagaccuugagaaguacguggaggauacgaaaauugaccugugguccuauaaugccgaacuccugguugcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 185546 - RNA, 1701 nt, Artificial Sequence; identical to SEQ ID NO: 185458
  derived and/or modified sequence opt5 from hemagglutinin__InfluenzaA__ACL12228

SEQ ID NO: 185547 - RNA, 1701 nt, Artificial Sequence; identical to SEQ ID NO: 185458
  derived and/or modified sequence opt5 from hemagglutinin__InfluenzaA__ACL12239

SEQ ID NO: 185548 - RNA, 1701 nt, Artificial Sequence
  derived and/or modified sequence opt5 from hemagglutinin__InfluenzaA__ACL12250
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacguuucucugcggagccucguggcuuccagcgggacgcuggaguucaauaacgaaucuuuuaauuggaccggagucacacagaacggcaccuccagcgccugcauccgcagaucuaauaacuccuucuuuagccggcuuaauuggcugacacauucuaaauucaaguauccugcucucaacgugaccaugcccaacaaugagaacuuugacaagcuguacauuuggggcguucaccauccugggacggauaaugaccagaucuuccuuuaugcccaggcguccggacgcauuacagugagcaccaaaagaucccaacagacagucaucccgaacauuggcucucggccccgcgugagaaauaucccuagccggaucuccauuuacuggaccaucgugaagcccggggauauucugcucaucaacagcaccggaaaucugauugccccucgcggcuacuuuaaaaucagaucugggaaguccagcaucaugcggucugacgcucccauuggaaaauguaacagcgaaugcaucacaccgaauggcuccauuccuaacgacaagcccuuccagaaugucaaccgcaucacguauggcgccuguccuagauacguuaagcagaauacccugaaacucgcuacagggaugcggaacgugcccgagaagcaaacccgcggaauuuuuggcgccaucgcgggguucaucgaaaauggaugggagggcaugguggaugggugguauggauucagacaccagaacucugagggcauuggccaggccgcugaccugaaaagcacacaagccgcuaucgaucagauuaacgggaaacuuaaucggcugaucggaaagaccaacgaaaaguuucaccagauugagaaagaguucuccgaagucgaaggcagaauccaggaccucgagaaguacguggaggauacgaagauugaccuguggagcuauaaugccgaacuucugguugcccucgagaaccaacauacaaucgaucugaccgacucugaaaugaauaaacuguuugagaagaccaaaaagcagcuccgcgaaaacgcugaggauauggggaauggaugcuucaaaaucuaccacaagugugacaacgcgugcauuggcuccauccggaaugggacauaugaucaugacguguacagagacgaggcccugaacaaucgcuuucagauuaagggcgucgaacuuaaaagcggauacaaggauuggauccuguggauuucuuucgcuaucuccugcuuucuccuguguaucgcccuucugggcuucauuaugugggccugccagaaagggaacauccgguguaauauuugcaucuga

SEQ ID NO: 185549 - RNA, 1701 nt, Artificial Sequence
  derived and/or modified sequence opt5 from hemagglutinin__InfluenzaA__ACL12261
augaaggccaaacugcucgugcugcuuugcgcuuucaccgccacagacgcggauacgaucuguauuggcuaccacgcuaacaauagcaccgacacagucgauaccguucuggagaagaacgugacagugacccauuccgucaaucuccuggaagacucucacaacgggaaacuuugcagacugaagggaaucgccccgcuccagcugggcaauuguagcauugccggguggauccugggaaacccugagugcgaaucccucuuuucuaaaaagagcugguccuauauugcugagacacccaauucugaaaacggcaccuguuaccccggguauuucgccgauuacgaggagcugcgggaacaacuuagcuccgugagcucuuuugagcgcuucgaaaucuuuccuaaggaguccagcuggcccaaucauacgguuaccaaaggagugacagcugccugcucucacaagggcagauccagcuucuaucggaaccugcucuggcugaccgagaaaaauggccuuuacccuaaccugucuaaguccuaugucaauaacaaagaaaaggaggugcucguucuguggggagugcaucaccccagcaauaucggggaccagcgcgcgauuuaccacacagaaaacgccuacgucuccguggugucuagccauuauaacagacgguuuaccccugagaucgcuaagcgcccgaaagucagaggccaggaagggcggauuaauuacuauuggacgcugcucgagcccggagauacaaucauuuucgaggccaacggcaaucugaucgcuccuugguacgccuuugcgcuuucccgcggguucggaagcggcauuaucaccucuaacgccuccauggacgaaugugaugcuaagugccagacaccccaaggcgccaucaauagcucucugccuuuucagaacguucaccccgugaccauuggggaguguccgaaauaugugagaagcaccaagcuccggauggucacaggacugcgcaauaucccuuccauucagucuagaggccuuuucggggcuaucgccggauuuauugaaggcggguggacgggaaugaucgacggcugguacggcuaucaucaccagaacgagcaagggagcggauacgccgcugaucagaaauccacccagaaugcgaucaacggcauuacaaauaaggugaacagcguuaucgaaaagaugaauacccaguucacagccguggggaaagaguucaacaagcuggagaaacggauggaaaaucucaacaagaaagucgacgauggauuucuggacauuuggaccuacaacgcugagcugcucgugcugcuugaaaaugagcgcacgcuggacuuccacgauucuaacguuaagaaucucuaugaaaaagugaagaaccaacugaagaauaacgccaaagagaucggcaaugggugcuuugaguucuaccauaaguguaacaaugaaugcauggaguccgucaaaaacggcacauaugacuaccccaaguauagcgaagagucuaaacuuaauagagagaagauugauggagugaagcuggaauccaugggcgucuaccagauccucgccaucuauagcaccguggcuuccucucugguucugcucgugagccugggggccauuuccuuuuggaugugcucuaacggaagccuucagugucggaucugcauuuga

SEQ ID NO: 185550 - RNA, 1689 nt, Artificial Sequence
  derived and/or modified sequence opt5 from hemagglutinin__InfluenzaA__ACN32272
auggccaucauuuaccugauccuccuguucaccgcugugagaggcgaccagauuugcaucggguaucacgccaacaauagcacagagaagauugauacgauccuugaacggaacgucaccguuacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacauuauggagaaagagaacccucgguauagccugugcuaccccggguccuuuaaugauuaugaagaacuuaagcaucugcucucuagcgugaagcacuucgaaaaagucaagauccugccuaaagaccgcuggacacaacauaccacaaccggaggcuccauggccugugccgugucuggcaagcccagcuuuuucagaaacaugguuuggcuuacgaccaaagggccuaauuacccgguggcucagggauccuauaacaauacaagcggcgagcagaugcugauuaucuggggaguccaccaccccaacgaugaggccgaacagcgggcucucuaccaaaauguggggaccuacguuucugccuccacaagcacccuguauaagcgcucuauuccugagaucgcggccagacccaaggugaacggccuggggucccggauggaauuuagcuggacgcuccuggacaugugggauacaaucaauuucgagucuaccggaaaccuugucgcuccugaauacggcuuuaaaauuuccaagcgcggcagcuccgggaucaugaaaacagagggaacccuggagaacugcgaaaccaagugucagacaccccucggcgccauuaauacgacccugccguuccauaacgugcacccucuuacaaucggggagugccccaaauaugugaagucugaaaaacugguccucgcuaccggacugagaaauguuccucagauugagagccggggccuguuuggggccaucgcgggauucaucgaaggcggcuggcaggggaugguggacggaugguacggcuaucaucacuccaacgaucaagggagcggauacgccgcugacaaggagucuacacagaaggccuuugauggcauuaccaauaaagugaacuccgucaucgagaagaugaauacgcaguucgaagcuguggggaaagaguuuagcaaccucgaaaagcgccuggagaaucuuaacaaaaagauggaagacggcuuccuggacguuuggacauauaaugccgagcuccuggugcuuauggagaacgaaagaacccuggauuuccacgacucuaaugucaagaaccucuacgauaaagugcggaugcagcugcgcgacaauguuaaggagcugggaaacggcuguuuugaguucuaccauaaaugcgauaacgaguguauggacagcgugaagaaugggaccuaugauuaccccaaauaugaggaagaguccaagcucaacagaaaugaaauuaagggagucaaacugucuagcaugggcguguaccaaauccuugccauuuaugcuacagucgcggggucccugagccucgccaucaugauggcuggaaucucuuuuuggaugugcuccaacggcagccugcagugccggauuuguaucuga

SEQ ID NO: 185551 - RNA, 1701 nt, Artificial Sequence
  derived and/or modified sequence opt5 from hemagglutinin__InfluenzaA__ACN32283
augaagaccaucauugcccugagcuacauccucugccugguguccgcucagaaauuccccggcaacgacaauucuacagccacgcuuugucuggggcaccaugcggucccuaacggaaccauuguuaagacaaucaccaaugaucaaauugaggugacaaacgcuaccgaacucgugcagagcuccucuacaggcgagaucugcgacagcccgcaccagauccuggauggggaaaauuguacccuuauugacgcccugcucggagauccccagugcgacggcuuucaaaacaaaaagugggaucuguucgucgagagauccaaagccuauucuaauuguuacccuuaugacgugcccgauuacgcuagccugcggucccucguugccagcucugggacgcuggaauuuaacaaugaguccuucaacuggaccggagugacacagaauggcaccagcucugcuugcauccgcagauccaacaauagcuuuuucucucggcuuaacuggcugacacaucucaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgcgagaacgcggaggauauggggaauggaugcuuuaagaucuaccacaagugugacaacgccugcauuggcuccauccggaaugggacauaugaucaugacguuuacagagacgaagcucuuaacaaucgcuuccagauuaaaggcguggagcucaagagcggauacaaagauuggauccuguggauuucuuuugccaucuccugcuuccugcuuugugucgcccugcucggcuuuaucaugugggcuugccagaaggggaacauucgguguaauaucugcauuuga

SEQ ID NO: 185552 - RNA, 1701 nt, Artificial Sequence
  derived and/or modified sequence opt5 from hemagglutinin__InfluenzaA__ACN32474
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagguccuugauggggaaaauuguacccugaucgacgcccuccugggagauccccagugcgacggcuuccaaaacaaaaagugggaucuguuuguggagagauccaaagccuauucuaauuguuacccuuaugacguucccgauuacacgagccuccggucccugguggcuagcucugggacccuugaguucaacaaugaauccuuuaacuggacaggagucacccagaauggcacaagcucugccugcauucgcagauccaacaauagcuucuuuucucggcugaacuggcucacccaucugaaguucaaguauccugcucuuaauaugacgaugcccaacaacgaggaauuugacaaacuguacaucuggggcgugcaccauccugggacagauaaugaccagauuuuccucuaugcccaggcguccggacgcaucaccguuagcacaaagagaucccaacagaccgugauuccgaacaucggcucucggccccgcgucagaaauauuccuagccggaucuccaucuacuggaccauugugaaacccggggauauccugcugauuaacagcacaggaaaucucaucgccccucgcggcuacuuuaagauuagaucugggaaauccagcaucaugcggucugacgcucccaucggaaaguguaacagcgagugcauuacgccgaauggcuccaucccuaacgacaagcccuuccagaaugugaaccgcauuaccuauggcgccuguccuagauacgucaaacagaauacacugaaacuugcuaccgggaugcggaacguucccgaaaaacaaacacgcggaaucuuuggcgccauugcgggguucaucgagaauggaugggagggcaugguggaugggugguauggauuuagacaccagaacucugaaggcaucggccaggccgcugaccucaagagcacccaagccgcuauugaucagaucaaugggaaacugaaccggcugauuggaaagacgaacgagaaauuccaccagaucgaaaaggaguucuccgaaguggagggccgcauucaggaccuugagaaguacgucgaagauacaaaaaucgaccuguggagcuauaaugccgagcuccugguggcccuggaaaaccaacauaccauugaucucaccgacucugagaugaauaagcuguuugaaaagacaaagaaacagcuuagagagaacgcugaggauauggggaauggaugcuucaagaucuaccacaagugugacaacgcgugcaucggcuccauucggaaugggaccuaugaucaugaaguuuacagagacgaggcccugaacaaucgcuuucagaucaaaggcguggaacucaagagcggauacaaagacuggauucuguggaucucuuucgcuauuuccugcuuucuucugugugucgcccuccugggcuucaucaugugggccugccagaaggggaacauccgguguaauauuugcaucuga

SEQ ID NO: 185553 - RNA, 1698 nt, Artificial Sequence; identical to SEQ ID NO: 185512
  derived and/or modified sequence opt5 from hemagglutinin__InfluenzaA__ACN32501

SEQ ID NO: 185554 - RNA, 1701 nt, Artificial Sequence
  derived and/or modified sequence opt5 from hemagglutinin__InfluenzaA__ACN32534
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucgucgagcggagcaaggccuauuccaauuguuacccuuaugacgugcccgauuacguuucucugcgcagccuuguggcuuccagcgggacgcuggaauuuaacaaugagucuuucaacuggaccggagucgcccaaaauggcacauccagcgcuugcaaaagacggucugacaaguccuuuuucagccgccucaacuggcugcaccagcuuaaguauaaauacccugcccugaaugugaccaugcccaacaaugagaaguuugauaaacucuauauuuggggcguucaucacccugggacagacucugaucagaucucccuguacgcgcaggccagcggaagagugaccgucuccacgaagcggucucaacagacagugauuccgaacaucggcagcgggcccugggugcgcggagucuccagcagaauuucuaucuacuggaccauuguuaaaccuggcgacauccugcucaucaacuccacagggaaucugauugcuccccggggauauuucaagauccgcagcggcaagucuagcauuaugagauccgacgccccuaucggcaaauguaacucugaaugcauuacccccaaugggagcaucccgaacggaaagccuuuucagaaugugaaccggaucaccuacggcgcuuguccccgcuaugugaaacagaauacacuuaagcuggccacggggaugagaaacgucccugagaaacaaacccggggaauuuucggcgcgaucgccggguuuauugaaaauggaugggagggcaugauggauggcugguacggguuccgccaccagaacuccgagggaacaggccaggcugccgaccucaagagcacccaagcugccaucaaucagauuaacgggaaacugaauagacuuaucgaaaagacaaacgagaaguuucaucagaucgaaaaagaguucucugaaguggagggacggauucaggaucuggagaaguauguugaagacaccaaaaucgaucucugguccuacaaugccgagcugcugguggcucucgaaaaccaacacacgauugaccugacagauagcgagaugaacaaacuuuucgaaagaaccaagaagcagcugcgcgagaaugcggaggacaugggcaacgggugcuuuaagaucuaucauaaaugugauaaugccugcauuggcucuauccggaacggaaccuacgaccacgaugucuacagagacgaagcucucaauaaccgcuuccagauuaagggcguggagcugaaauccggguauaaggacuggauccuuuggaucagcuuugccauuuccugcuuccugcucuguaucguucugcugggauuuauuaugugggccugccagaaaggcaauauccgguguaacauuugcaucuga

SEQ ID NO: 185555 - RNA, 1701 nt, Artificial Sequence
  derived and/or modified sequence opt5 from hemagglutinin__InfluenzaA__ACN32545
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccauugcgacggcuuucagaacaaaaagugggaucuguucgucgagagaagcaaagccuauuccaauuguuacccuuaugacgugcccgauuacgcuucucuccggagccugaucgccuccagcgggacgcuugaauuuaacaaugagucuuucaacuggaccggaguuacacaaaauggcaccuccagcgcuugcauucgcagaucuaacaauuccuuuuucagccggcugaacuggcucacacaccugaaguuuaaguauccugcccuuaaugugaccaugcccaacaacgagaaauucgacaagcuguacaucuggggcguccaucacccugggacggauaaugaccagauuuuucucuaugcgcaggccucuggacgcaucacaguguccaccaaaagaagccagcaaacaguuauuccgaacaucggcucccggccccgcgugagaaauaucccuucucggauuagcaucuacuggaccauugucaagcccggggauauccugcugauuaacuccaccggaaaucucaucgcuccucgcggcuacuucaaaaucagaagcgggaagucuuccauuaugcggagcgacgcccccaucggaaaguguaacucugaaugcauuacaccgaauggcagcaucccuaacgacaaacccuuucagaaugugaaccgcauuacguauggcgcuuguccuagauacgugaagcagaauacccugaaacuugccacagggaugcggaacguccccgagaagcagacccgcggaaucuucggcgcgaucgccggguuuauugaaaauggaugggagggcaugguugaugggugguauggauucagacaccaaaacuccgagggcaucggccaggcugccgaccugaaaucuacacaggcugccauugaucaaaucaaugggaagcucaaccggcugauuggaaaaaccaacgaaaaguuccaucagaucgagaaggaauuuagcgagguggaaggccgcauucaggaccuugagaaauacguggaggauacgaagaucgaccugugguccuauaaugccgaacuccuggucgcucuggagaaccagcacacaaucgaucucaccgacagcgaaaugaauaaacuguucgagaagaccaaaaagcaacuuagagaaaacgcggaggauauggggaauggaugcuuuaagauuuaccauaaaugugacaacgccugcaucggcucuauucggaaugggacauaugaucacgacguguacagagacgaggcucugaacaaucgcuuccagaucaagggcguugaacucaaauccggauacaaggauuggauucuguggaucagcuuugccaucucuugcuuccuucuguguguggcccuccugggcuuuauuaugugggcuugccagaaagggaacauccgguguaauauuugcaucuga

SEQ ID NO: 185556 - RNA, 1698 nt, Artificial Sequence
  derived and/or modified sequence opt5 from hemagglutinin__InfluenzaA__ACN32793
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaccccgaaucccgagaacggcacguguuauccuggguacuuugccgacuaugaggaacugagagagcaacucuccucugucagcuccuucgaacgguuugagaucuuccccaaggagagcucuuggccuaaucauaccgugacaggaguuuccgccagcugcucucacaacggcaaguccagcuuuuaccgcaaucugcuuuggcugaccggcaaaaacgggcucuaucccaaucugucugaauccuacgcuaacaauaaggagaaagaagugcugguccucuggggagugcaucacccuccgaacaucggcgaucagagagcccuguaccacacagagaacgcuuaugugagcgucguuuccucucauuacagccggcgcuucacccccgaaauugccaagagaccuaaagugcgggaccaggaggggcgcaucaauuauuacuggacgcuucuggagcccggagauacaauuaucuuugaagcgaacggcaaucucauugccccuagauucgcuuuugcccugucccggggguucggaagcggcaucauuaccucuaacgcucccauggacgagugugaugccaagugccagacaccgcaaggcgcgaucaauuccagccuuccuuuucagaacgugcaccccgucaccaucggggaauguccuaaguaugugcgcucuaccaaacugagaaugguuacaggacuccggaauauucccagcauccagucccgcggccuguucggggccauugcuggauuuaucgagggcggguggacgggaaugguggacggcugguacggcuaucaucaccagaacgaacaagggucuggauacgccgcugaucaaaagagcacccagaaugccauuaacggcaucacaaauaaagucaacuccgugaucgagaagaugaauacccaguucacagccguugggaaagaguucaacaagcuggaaagacggauggagaaucucaacaaaaagguggacgauggauuucuggacauuuggaccuacaacgcugaacuucugguccuccuggagaaugaacgcacgcuugacuuccacgauagcaacgugaagaaucuguaugagaaagucaagucucagcucaaaaacaaugcgaaggagaucggcaacgggugcuuugaguucuaccauaaauguaaugacgaaugcauggaauccgugaagaacggcacauaugauuaccccaaguauagcgaggagucuaaacugaauagagaaaagauugacggaguuaaacuggaguccaugggcguguaccagauccucgccauuuauagcaccgucgcuuccucucuggugcuucugguuagccucggggccaucuccuuuuggaugugcucuaacggaagccugcagugucggaucugcauuuga

SEQ ID NO: 185557 - RNA, 1698 nt, Artificial Sequence; identical to SEQ ID NO: 184981
  derived and/or modified sequence opt5 from hemagglutinin__InfluenzaA__ACN32804

SEQ ID NO: 185558 - RNA, 1698 nt, Artificial Sequence; identical to SEQ ID NO: 184969
  derived and/or modified sequence opt5 from hemagglutinin__InfluenzaA__ACN32815

SEQ ID NO: 185559 - RNA, 1698 nt, Artificial Sequence; identical to SEQ ID NO: 184979
  derived and/or modified sequence opt5 from hemagglutinin__InfluenzaA__ACN32826

SEQ ID NO: 185560 - RNA, 1701 nt, Artificial Sequence; identical to SEQ ID NO: 185458
  derived and/or modified sequence opt5 from hemagglutinin__InfluenzaA__ACN32848

SEQ ID NO: 185561 - RNA, 1701 nt, Artificial Sequence
  derived and/or modified sequence opt5 from hemagglutinin__InfluenzaA__ACN32870
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacagcgaaugcaucacaccgaauggcuccauuccuaacgacaagcccuuccagaaugugaaccgcaucacguauggcgcuuguccuagauacgucaagcagaauacccugaaacucgccacagggaugcggaacguucccgagaagcaaacccgcggaauuuuuggcgcgaucgccggguucaucgaaaauggaugggagggcaugguggaugggugguauggauucagacaccagaacucugagggcauuggccaggcugccgaccugaaaagcacacaagcugccaucgaucagauuaacgggaaacuuaaucggcugaucggaaagaccaacgaaaaguuucaccagauugagaaagaguucuccgaaguggaaggcagaauccaggaccucgagaaguacgucgaggauacgaagauugaccuguggagcuauaaugccgaacuucugguggcucucgagaaccaacauacaaucgaucugaccgacucugaaaugaauaaacuguuugagaagaccaaaaagcagcuccgcgaaaacgcggaggauauggggaauggaugcuucaaaaucuaccacaagugugacaacgccugcauuggcuccauccggaaugggacauaugaucaugacguuuacagagacgaggcucugaacaaucgcuuucagauuaagggcguggaacuuaaaagcggauacaaggauuggauccuguggauuucuuucgccaucuccugcuuucuccuguguaucgcccuucugggcuucauuaugugggcuugccagaaagggaacauccgguguaauauuugcaucuga

SEQ ID NO: 185562 - RNA, 1701 nt, Artificial Sequence; identical to SEQ ID NO: 185561
  derived and/or modified sequence opt5 from hemagglutinin__InfluenzaA__ACN32892

SEQ ID NO: 185563 - RNA, 1701 nt, Artificial Sequence; identical to SEQ ID NO: 185458
  derived and/or modified sequence opt5 from hemagglutinin__InfluenzaA__ACN32903

SEQ ID NO: 185564 - RNA, 1701 nt, Artificial Sequence
  derived and/or modified sequence opt5 from hemagglutinin__InfluenzaA__ACN32914
augaagaccaucauugcccugagcuacauccucugccuggcuuucgcccagaaacuucccggcaacgacaauuccacagcgacgcugugucucgggcaccaugcugugccuaacggaaccauugucaagacaaucaccaaugaucaaauugagguuacaaacgccaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucguggagagaagcaaggcuuauuccaauuguuacccuuaugacguccccgauuacgccucucuccggagccugguggcuuccagcgggacgcuugaauuuaacaaugagucuuucaacuggaccggaguuacacagaauggcaccuccagcgccugcauccgcagaucuaacaauuccuuuuucagccggcugaacuggcucacacaucugaaguuuaaguauccugcgcuuaaugugaccaugcccaacaacgagcaguucgacaaacuguacauuuggggcguccaccauccugggacggauaaugaccagaucuuucucuaugcccaggcuucuggacgcauuacaguguccaccaagagaagccaacagacaguuaucccgaacauuggcucccggccccgcgugagaaauaucccuucucggaucagcauuuacuggaccaucgucaaacccggggauauucugcugaucaacuccaccggaaaucucauugccccucgcggcuacuucaagaucagaagcgggaaaucuuccaucaugcggagcgacgcucccauuggaaaguguaacucugaaugcaucacaccgaauggcagcauuccuaacgacaagcccuuucagaaugugaaccgcaucacguauggcgccuguccuagauacgugaaacaaaauacccugaaacuugcgacagggaugcggaacguccccgagaaacagacccgcggaauuuucggcgccaucgcuggguuuaucgaaaauggaugggagggcaugguugaugggugguauggauucagacaccagaacuccgagggccggggccaagccgcugaccugaagucuacacaggccgccauugaucagaucaaugggaaacucaacagacugauuggaaagaccaacgaaaaauuccaccagaucgagaaggaauuuagcgagguggaaggccgcauucaagaccuugagaaguacguggaggauacgaaaaucgaccugugguccuauaaugcugaacuccuggucgcgcuggagaaccagcauacaauugaucucaccgacagcgaaaugaauaagcuguucgagaaaaccaagaaacagcuucgggaaaacgccgaggauauggggaauggaugcuuuaagaucuaccacaagugugacaacgcuugcaucggcucuauuagaaaugggacauaugaucaugacguguaccgcgacgaggcccugaacaaucgguuccagaucaaaggcguugaacucaaguccggauacaaagauuggauucuguggaucagcuuugccauuucuugcuuccuucuguguguggcucuccugggcuuuaucaugugggccugccaaaaggggaacaucagauguaauauuugcaucuga

SEQ ID NO: 185565 - RNA, 1701 nt, Artificial Sequence; identical to SEQ ID NO: 185458
  derived and/or modified sequence opt5 from hemagglutinin__InfluenzaA__ACN32925

SEQ ID NO: 185566 - RNA, 1701 nt, Artificial Sequence
  derived and/or modified sequence opt5 from hemagglutinin__InfluenzaA__ACN32936
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcaucaagaauaucccuagcagaauuuccaucuacuggaccauugucaaacccggggauauccugcucauuaacagcaccggaaaucugaucgcuccucggggcuacuuuaagauccgcucugggaaauccagcauuaugagaucugacgcccccaucggaaaguguaacagcgaaugcauuacaccgaauggcuccaucccuaacgacaagcccuuccagaaugugaaccggauuacguauggcgcuuguccucgcuacgugaaacagaauacccugaagcucgccacagggaugagaaacguccccgagaaacaaacccggggaaucuuuggcgcgaucgccggguucauugaaaauggaugggagggcaugguugaugggugguauggauuccgccaccagaacucugagggcaucggccaggcugccgaccuuaagagcacacaagcugccauugaucagaucaacgggaaacugaauagacugauuggaaagaccaacgaaaaauuucaccagaucgagaaggaguucuccgaaguggaaggccggauucaggaccucgagaaguacguggaggauacgaaaaucgaccuguggagcuauaaugccgaacuucuggucgcucucgagaaccaacauacaaucgaucugaccgacucugaaaugaauaagcuguuugagaaaaccaagaaacagcucagagaaaacgcggaggauauggggaauggaugcuucaagauuuaccacaagugugacaacgccugcaucggcuccauucgcaaugggacauaugaucaugacguguaccgggacgaggcucugaacaauagauuucagaucaaaggcguugaacuuaagagcggauacaaagauuggauucuguggaucucuuucgccaucuccugcuuucuccuguguauugcccuucugggcuucaucaugugggcuugccagaaggggaacauucgcuguaauaucugcauuuga

SEQ ID NO: 185567 - RNA, 1701 nt, Artificial Sequence; identical to SEQ ID NO: 185458
  derived and/or modified sequence opt5 from hemagglutinin__InfluenzaA__ACN32947

SEQ ID NO: 185568 - RNA, 1701 nt, Artificial Sequence
  derived and/or modified sequence opt5 from hemagglutinin__InfluenzaA__ACN32958
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaaauaaagccuauagcaacuguuacccuuaugacgugcccgauuacgcuucccuccggucucugguugccagcuccgggacgcuugaauuuaauaacgagagcuucaauuggaccggagugacacagaacggcaccucuuccgcuugcauccgcagaagcaauaacuccuuuuucucucggcugaauuggcucacacaucugaaguuuaaguauccugcccuuaacgucaccaugcccaacaaugagcaguucgacaaacuguacauuuggggcgugcaccauccugggacggauaacgaccagaucuuucucuaugcgcaagccagcggacgcauuacaguuucuaccaagagaucccagcagacagugaucccgaauauuggcagccggccccgcgucagaaacaucccuucccggaucucuauuuacuggaccaucgugaaacccggggauauucugcugaucaauagcaccggaaaccucauugcuccucgcggcuacuucaagaucagauccgggaaaagcucuaucaugcgguccgacgcccccauuggaaaguguaauagcgaaugcaucacaccgaacggcucuauuccuaaugacaagcccuuucagaacgugaaucgcaucacguauggcgcuuguccuagauacgucaaacaaaacacccugaaacuugccacagggaugcggaauguucccgagaagcagacccgcggaauuuucggcgcgaucgccggguuuaucgaaaacggaugggagggcaugguggaugggugguauggauucagacaccagaauagcgagggccggggccaagcugccgaccugaaguccacacaggcugccauugaucagaucaacgggaaacucaacagacugauuggaaagaccaaugaaaaauuccaccagaucgagaaggaauuuucugagguggaaggccgcauucaagaccuugagaaguacgucgaggauacgaaaaucgaccuguggagcuauaacgccgaacuccugguggcucuggagaaucagcauacaauugaucucaccgacuccgaaaugaacaagcuguucgagaaaaccaagaaacagcuucgggaaaaugcggaggauauggggaacggaugcuuuaagaucuaccacaagugugacaaugccugcaucggcagcauuagaaacgggacauaugaucaugacguuuaccgcgacgaggcucugaauaaccgguuccagaucaaaggcguggaacucaagucuggauacaaagauuggauucuguggaucuccuuugccauuagcugcuuccuucugugugucgcccuccugggcuuuaucaugugggcuugccaaaaggggaauaucagauguaacauuugcaucuga

SEQ ID NO: 185569 - RNA, 1701 nt, Artificial Sequence
  derived and/or modified sequence opt5 from hemagglutinin__InfluenzaA__ACN32969
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagguccuugauggggaaaauuguacccugaucgacgcccuccugggagauccccagugcgacggcuuccaaaacaaaaagugggaucuguuuguggagagauccaaagccuauucuaauuguuacccuuaugacguucccgauuacgcuagccuccggucccugguggccagcucugggacgcuugaguucaacaaugaauccuuuaacuggaccggagucacacagaauggcaccagcucugcuugcauucgcagauccaacaauagcuucuuuucucggcugaacuggcucacacauuccaaguucaaguauccugcccugaaugugaccaugcccaacaacgaggaauuugacaaacuuuacaucuggggcguucaccauccugggacggauaaugaccagauuuuccuguaugcgcaggccagcggacgcaucacaguguccaccaagagaucucaacagacagucauuccgaacaucggcagccggccccgcgugagaaauauuccuucccggaucagcaucuacuggaccauugugaaacccggggauauccuccugauuaacucuaccggaaaucugaucgcuccucgcggcuacuuuaagcucagauccgggaaaagcucuauuaugcggagcgacgcccccaucggaaaguguaacuccgagugcaucacaccgaauggcucuauuccuaacgacaagcccuuccagaaugucaaccgcaucacguauggcgcuuguccuagauacguuaaacagaauacccugaaacuugccacagggaugcggaacgugcccgaaaaacaaacccgcggaauuuuuggcgcgaucgccggguucauugagaauggaugggagggcaugguggaugggugguauggauuuagacaccagaacagcgaaggcaucggccaggcugccgaccugaaguccacacaagcugccaucgaucagauuaaugggaaacucaaccggcugaucggaaagaccaacgagaaauuccaccagauugaaaaggaguucagcgaagucgagggcagaauccaggaccuugagaaguacguggaagauacgaaaauugaccuguggucuuauaaugccgagcuccugguugcucuggaaaaccaacauacaaucgaucucaccgacuccgagaugaauaagcuguuugaaaagaccaagaaacagcuucgcgagaacgcggaggauauggggaauggaugcuucaagauuuaccacaagugugacaacgccugcaucggcagcauccggaaugggacauaugaucaugaaguguacagagacgaggcucugaacaaucgcuuucagauuaaaggcgucgaacucaagucuggauacaaagacuggauccuguggauuuccuucgccaucagcugcuuucuucuguguguggcccuccugggcuucauuaugugggcuugccagaaggggaacauccgguguaauaucugcauuuga

SEQ ID NO: 185570 - RNA, 1701 nt, Artificial Sequence
  derived and/or modified sequence opt5 from hemagglutinin__InfluenzaA__ACN32980
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagcccauuccaauuguuauccuuacgacgugcccgauuaugcuucucuccggagccugguugccuccagcgggacgcuugaauuuaacaaugagucuuucaacuggaccggagugacacagaauggcaccuccagcgcuugcauccgcagaucuaagaacuccuuuuucagccggcugaauuggcucacacaccugaaguuuaaauacccugcccuuaacgucaccaugcccaaugacgagaaguucgauaaacuguauauuuggggcgugcaucacccugggacggacaacgaucagaucuuucucuacgcgcaggccucuggacgcauuacaguuuccaccaagagaagccaacagacagugaucccgaacauuggcucccggccccgcgucagaaauaucccuucucggaucagcauuuauuggaccaucgugaaacccggggacauucugcugaucaacuccaccggaaaucucauugcuccucgcggcuacuucaagaucagaagcgggaagucuuccaucaugcggagcgacgcccccauuggaaaauguaacucugaaugcaucacaccgaauggcagcauuccuaacgauaagcccuuucagaaugugaaccgcaucacguacggcgcuuguccuagauaugucaaacagaauacccugaaacuugccacagggaugcggaacguucccgagaagcaaacccgcggaauuuucggcgcgaucgccggguuuaucgaaaauggaugggagggcaugguggacgggugguacggauucagacaccagaacuccgagggcauuggccaggcugccgaucugaagucuacacaagcugccaucgaccagauuaaugggaaacucaaccggcugaucggaaagaccaaugaaaaguuccaucagauugagaaagaauuuagcgagguggaaggcagaauccaggaucuugagaaguaugucgaggacacgaaaauugaucugugguccuacaacgccgaacuccugguggcucuggagaaccaacacacaaucgaccucaccgauagcgaaaugaauaagcuguucgagaaaaccaagaagcagcuucgcgaaaacgcggaggacauggggaauggaugcuuuaaaaucuaucauaagugugauaacgccugcguuggcucuauucggaaugggacauacgaccacgacguguauagagaugaggcucugaacaaucgcuuccagaucaaaggcgucgaacucaaguccggauacaaagacuggauucuguggaucagcuuugccauuucuugcuuccuucuguguguggcccuccugggcuuuaucaugugggcuugccagaaggggaacauccgguguaauauuugcaucuga

SEQ ID NO: 185571 - RNA, 1701 nt, Artificial Sequence; identical to SEQ ID NO: 185458
  derived and/or modified sequence opt5 from hemagglutinin__InfluenzaA__ACN32991

SEQ ID NO: 185572 - RNA, 1701 nt, Artificial Sequence; identical to SEQ ID NO: 185458
  derived and/or modified sequence opt5 from hemagglutinin__InfluenzaA__ACN33002

SEQ ID NO: 185573 - RNA, 1701 nt, Artificial Sequence; identical to SEQ ID NO: 185458
  derived and/or modified sequence opt5 from hemagglutinin__InfluenzaA__ACN33013

SEQ ID NO: 185574 - RNA, 1701 nt, Artificial Sequence
  derived and/or modified sequence opt5 from hemagglutinin__InfluenzaA__ACN33035
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacguguggggcguucaccauccugggacggauaaugaccagauuuuucucuaugcgcaagccucuggacgcaucacaguguccaccaagagaagccagcagacagucauuccgaacaucggcucccggccccgcgugagaaauauuccuucucggaucagcaucuacuggaccauugugaaacccggggauauccugcugauuaacuccaccggaaaucucaucgcuccucgcggcuacuucaagauuagaagcgggaaaucuuccaucaugcggagcgacgcccccaucggaaaguguaacucugaaugcauuacaccgaauggcagcaucccuaacgacaagcccuuucagaaugucaaccgcauuacguauggcgcuuguccuagauacguuaaacaaaauacccugaaacuugccacagggaugcggaacgugcccgagaagcagacccgcggaaucuucggcgcgauugccggguuuaucgaaaauggaugggagggcaugguggaugggugguauggauucagacaccagaacuccgagggccggggccaagcugccgaccugaagucuacacaggcugccaucgaucagauuaaugggaaacucaacagacugaucggaaagaccaacgaaaaauuccaccagauugagaaggaauuuagcgaggucgaaggccgcauccaagaccuugagaaguacguggaggauacgaaaauugaccugugguccuauaaugccgaacuccugguugcucuggagaaccagcauacaaucgaucucaccgacagcgaaaugaauaagcuguucgagaaaaccaagaaacagcuucgggaaaacgcggaggauauggggaauggaugcuuuaagauuuaccacaagugugacaacgccugcaucggcucuaucagaaaugggacauaugaucaugacguguaccgcgacgaggcucugaacaaucgguuccagauuaaaggcgucgaacucaaguccggauacaaagauuggauccuguggauuagcuuugccaucucuugcuuccuucuguguguggcccuccugggcuuuauuaugugggcuugccaaaaggggaacaucagauguaauaucugcauuuga

SEQ ID NO: 185575 - RNA, 1701 nt, Artificial Sequence; identical to SEQ ID NO: 185458
  derived and/or modified sequence opt5 from hemagglutinin__InfluenzaA__ACN33046

SEQ ID NO: 185576 - RNA, 1701 nt, Artificial Sequence; identical to SEQ ID NO: 185458
  derived and/or modified sequence opt5 from hemagglutinin__InfluenzaA__ACN33057

SEQ ID NO: 185577 - RNA, 1701 nt, Artificial Sequence; identical to SEQ ID NO: 185458
  derived and/or modified sequence opt5 from hemagglutinin__InfluenzaA__ACN33068

SEQ ID NO: 185578 - RNA, 1701 nt, Artificial Sequence; identical to SEQ ID NO: 185561
  derived and/or modified sequence opt5 from hemagglutinin__InfluenzaA__ACN33079

SEQ ID NO: 185579 - RNA, 1698 nt, Artificial Sequence
  derived and/or modified sequence opt5 from hemagglutinin__InfluenzaA__ACN33090
augaaggugaaacugcucauccugcuuugcaccuucacagccacguacgcugacaccauuuguaucggcuaucacgccaacaauagcacagauaccgucgacacaguucuggagaagaacgugaccgugacacauuccgucaaucuccuggaagauucucacaacgggaaacuuugccugcucaagggaauugcgccccugcagcugggcaauuguagcguggcuggguggauccucggaaacccugagugcgaacugcuuauuuccaaagagucuuggagcuacaucguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgccagcugcucucacaacggcaaguccagcuuuuaccgcaaucugcuuuggcugaccggcaaaaacgggcucuaucccaaucugucuaaguccuacgcuaacaauaaagaaaaggagguucuggugcucuggggaguccaucacccuagcaacauuggcgaucagagagcccuguaccacacagaaaacgcuuauguguccguggucucuagccauuacucccggcgcuucaccccggagaucgccaaaagacccaagguucgggaccaggaagggcgcauuaauuauuacuggacgcuucuggagccuggagauacaaucauuuuugaggcgaacggcaaucucaucgcccccagauucgcuuuugcccugagccggggguucggaucuggcauuaucaccuccaacgcuccuauggacgaaugugaugccaagugccagacaccccaaggcgcgaucaauagcucucuuccguuucagaacgugcacccugugaccauuggggagugucccaaauauguccgcagcaccaagcugagaauggugacaggacuccggaauaucccuuccauucagucucgcggccuguucggggccaucgcuggauuuauugaaggcggguggacgggaaugguugacggcugguacggcuaucaucaccagaacgagcaagggagcggauacgccgcugaucagaaauccacccagaaugccaucaacggcaucacaaauaaggugaacagcgucauugaaaagaugaauacccaguucacagccguggggaaagaguucaacaaacuggagagacggauggaaaaucucaacaagaagguugacgauggauuucuggacaucuggaccuacaacgcugagcuucuggugcuccuggaaaaugagcgcacgcuugacuuccacgauucuaacgucaaaaaucuguaugaaaaggugaaaucccaacucaagaacaaugcgaaagagauuggcaacgggugcuuugaguucuaccauaaguguaaugacgaaugcauggagagcgucaagaacggcacauaugauuaccccaaauauucugaagaguccaagcugaauagagagaaaaucgacggagugaagcuggaaagcaugggcguuuaccagauucucgccaucuauuccaccguggcuucuagccugguccuucuggugucccucggggccaucucuuuuuggaugugcagcaacggaucccugcagugucggauuugcaucuga

SEQ ID NO: 185580 - RNA, 1698 nt, Artificial Sequence; identical to SEQ ID NO: 184938
  derived and/or modified sequence opt5 from hemagglutinin__InfluenzaA__ACN33101

SEQ ID NO: 185581 - RNA, 1701 nt, Artificial Sequence; identical to SEQ ID NO: 185561
  derived and/or modified sequence opt5 from hemagglutinin__InfluenzaA__ACN33112

SEQ ID NO: 185582 - RNA, 1698 nt, Artificial Sequence; identical to SEQ ID NO: 185512
  derived and/or modified sequence opt5 from hemagglutinin__InfluenzaA__ACN33123

SEQ ID NO: 185583 - RNA, 1698 nt, Artificial Sequence; identical to SEQ ID NO: 185512
  derived and/or modified sequence opt5 from hemagglutinin__InfluenzaA__ACN33145

SEQ ID NO: 185584 - RNA, 1701 nt, Artificial Sequence; identical to SEQ ID NO: 185458
  derived and/or modified sequence opt5 from hemagglutinin__InfluenzaA__ACN33156

SEQ ID NO: 185585 - RNA, 1701 nt, Artificial Sequence
  derived and/or modified sequence opt5 from hemagglutinin__InfluenzaA__ACN33178
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacagcgaaugcaucacaccgaauggcuccauuccuaacgacaagcccuuccagaaugugaaccgcaucacguauggcgcuuguccuagauacgucaagcagaauacccugaaacucgccacagggaugcggaacguucccgagaagcaaacccgcggaauuuuuggcgcgaucgccggguucaucgaaaauggaugggagggcaugguggaugggugguauggauucagacaccagaacucugagggcauuggccaggcugccgaccugaaaagcacacaagcugccaucgaucagauuaacgggaaacuuaaucggcugaucggaaagaccaacgaaaaguuucaccagauugagaaagaguucuccgaaguggaaggcagaauccaggaccucgagaaguacgucgaggauacgaagauugaccuguggagcuauaaugccgaacuucugguggcucucgagaaccaacauacaaucgaucugaccgacucugaaaugaauaaacuguuugagaagaccaaaaagcagcuccgcgaaaacgcggaggauauggggaauggaugcuucaaaaucuaccacaagugugacaacgccugcauuggcuccauccggaaugggacauaugaucaugacguuuacagagacgaggcucugaacaaucgcuuucacauuaagggcguggaacuuaaaagcggauacaaggauuggauccuguggauuucuuucgccaucuccugcuuucuccuguguaucgcccuucugggcuucauuaugugggcuugccagaaagggaacauccgguguaauauuugcaucuga

SEQ ID NO: 185586 - RNA, 1701 nt, Artificial Sequence; identical to SEQ ID NO: 185458
  derived and/or modified sequence opt5 from hemagglutinin__InfluenzaA__ACN33189

SEQ ID NO: 185587 - RNA, 1701 nt, Artificial Sequence
  derived and/or modified sequence opt5 from hemagglutinin__InfluenzaA__ACN33200
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucguggaacccggggauauucugcucaucaacagcaccggaaaucugauugcuccucgcggcuacuuuaagaucagaucugggaaauccagcaucaugcggucugacgcccccauuggaaaguguaacagcgagugcaucacaccgaauggcuccauuccuaacgacaaacccuuccagaaugugaaccgcaucacguauggcgcuuguccuagauacgucaagcagaauacccugaagcucgccacagggaugcggaacguucccgaaaaacaaacccgcggaauuuuuggcgcgaucgccggguucaucgagaauggaugggagggcaugguggaugggugguauggauucagacaccagaacucugaaggcauuggccaggcugccgaccugaaaagcacacaagcugccaucgaucagauuaacgggaaacuuaaucggcugaucggaaagaccaacgagaaauuucaccagauugaaaaggaguucuccgaaguggagggcagaauccaggaccucgagaaauacgucgaagauacgaagauugaccuguggagcuauaaugccgagcuucugguggcucucgaaaaccaacauacaaucgaucugaccgacucugagaugaauaagcuguuugaaaagaccaagaaacagcuccgcgagaacgcggaggauauggggaauggaugcuucaagaucuaccacaaaugugacaacgccugcauuggcuccauccggaaugggacauaugaucaugacguuuacagagacgaagcucugaacaaucgcuuucagauuaagggcguggagcuuaagagcggauacaaagauuggauccuguggauuucuuucgccaucuccugcuuucuccuguguaucgcccuucugggcuucauuaugugggcuugccagaaggggaacauccgguguaauauuugcaucuga

SEQ ID NO: 185588 - RNA, 1701 nt, Artificial Sequence
  derived and/or modified sequence opt5 from hemagglutinin__InfluenzaA__ACN33211
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucuguccaaccgguuccagaucaaaggcguggaacucaagagcggauacaaagauuggauucuguggaucucuuuugccauuuccugcuuccuucugugugucgcccuccugggcuuuaucaugugggcuugccaaaaggggaauaucagauguaacauuugcaucuga

SEQ ID NO: 185589 - RNA, 1698 nt, Artificial Sequence; identical to SEQ ID NO: 184980
  derived and/or modified sequence opt5 from hemagglutinin__InfluenzaA__ACN42981

SEQ ID NO: 185590 - RNA, 1698 nt, Artificial Sequence; identical to SEQ ID NO: 185214
  derived and/or modified sequence opt5 from hemagglutinin__InfluenzaA__ACN42992

SEQ ID NO: 185591 - RNA, 1701 nt, Artificial Sequence; identical to SEQ ID NO: 185458
  derived and/or modified sequence opt5 from hemagglutinin__InfluenzaA__ACN43003

SEQ ID NO: 185592 - RNA, 1701 nt, Artificial Sequence
  derived and/or modified sequence opt5 from hemagglutinin__InfluenzaA__ACN43014
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaucggagugacccagaacggcacauccagcgcuugcauucgcagaucuaauaacuccuucuuuagccggcuuaauuggcugacccauucuaaauucaaguauccugcccucaacgucacaaugcccaacaaugagaacuuugacaagcuguacaucuggggcgugcaccauccugggaccgauaaugaccagauuuuccuuuaugcgcaggccuccggacgcaucacgguuagcacaaaaagaucccaacagaccgugauuccgaacaucggcucucggccccgcgucagaaauaucccuagccggauuuccaucuacuggacaauugugaagcccggggauauccugcucauuaacagcaccggaaaucugaucgcuccucgcggcuacuuuaaaaucagaucugggaaguccagcauuaugcggucugacgcccccaucggaaacuguaauagcgaaugcauuaccccgaacggcuccaucccuaaugacaaacccuuccagaacgugaaucgcauuacauauggcucuuguccuagauacgucaagcagaacacgcugaagcucgcuaccgggaugcggaauguucccgagaaacaaacacgcggaaucuuuggcgccaucgcgggguucauugaaaacggaugggagggcaugguggaugggugguauggauucagacaccagaacagcgagggcaucggccaggccgcugaccugaaguccacccaagccgcuauugaucagaucaaugggaaacuuaaccggcugauuggaaagacaaaugaaaaauuucaccagaucgagaaggaguucagcgaaguggaaggccgcauucaggaccucgagaaauacgucgaggauaccaagaucgaccuguggucuuauaacgccgaacuucugguggcccucgagaaucaacauacgaucgaucugacagacuccgaaaugaacaagcuguuugagaaaaccaagaaacagcucagagaaaaugcugaggauauggggaacggaugcuucaagauuuaccacaaaugugacaaugcgugcaucggcagcauucggaacgggaccuaugaucaugacguuuacagagacgaggcccugaauaaccgcuuucagaucaagggcguggaacuuaagucuggauacaaagauuggauucuguggaucuccuucgcuaucagcugcuuucuccuguguauugcccuucugggcuucaucaugugggccugccagaaggggaauauucgguguaacaucugcauuuga

SEQ ID NO: 185593 - RNA, 1701 nt, Artificial Sequence; identical to SEQ ID NO: 185458
  derived and/or modified sequence opt5 from hemagglutinin__InfluenzaA__ACN43025

SEQ ID NO: 185594 - RNA, 1701 nt, Artificial Sequence; identical to SEQ ID NO: 185458
  derived and/or modified sequence opt5 from hemagglutinin__InfluenzaA__ACN43036

SEQ ID NO: 185595 - RNA, 1701 nt, Artificial Sequence; identical to SEQ ID NO: 185458
  derived and/or modified sequence opt5 from hemagglutinin__InfluenzaA__ACN43047

SEQ ID NO: 185596 - RNA, 1701 nt, Artificial Sequence
  derived and/or modified sequence opt5 from hemagglutinin__InfluenzaA__ACN43058
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgggucuccgcaccagauccuugacggagaaaauuguacccugauugaugcccuccugggcgacccccagugcgauggguuucaaaacaaaaagugggaccuguucgucgagagaagcaaagccuauuccaauuguuacccuuaugaugugcccgacuacgcuucucuccggagccugguugccuccagcggaacgcuugaauuuaacaaugagucuuucaacuggaccggcgugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgauaaacuguacauuuggggagugcaccauccugggacggacaaugaucagaucuuucucuaugcgcaagccucuggccgcauuacaguuuccaccaagagaagccagcagacagugaucccgaacauugggucccggccccgcgucagaaauaucccuucucggaucagcauuuacuggaccaucgugaaacccggagacauucugcugaucaacuccaccggcaaucucauugcuccucgcggguacuucaagaucagaagcggaaaaucuuccaucaugcggagcgaugcccccauuggcaaguguaacucugaaugcaucacaccgaauggcagcauuccuaacgacaagcccuuucagaaugugaaccgcaucacguauggggcuuguccuagauacgucaaacaaaauacccugaaacuugccacaggaaugcggaacguucccgagaagcagacccgcggcauuuucggggcgaucgccggauuuaucgaaaauggcugggaggggaugguggacggaugguauggcuucagacaccagaacuccgagggccgggggcaagcugccgaucugaagucuacacaggcugccauugaccagaucaauggaaaacucaacagacugauuggcaagaccaacgaaaaauuccaccagaucgagaaggaauuuagcgagguggaagggcgcauucaagaucuugagaaguacgucgaggacacgaaaaucgaucugugguccuauaaugccgaacuccugguggcucuggagaaccagcauacaauugaccucaccgauagcgaaaugaauaagcuguucgagaaaaccaagaaacagcuucgggaaaacgcggaggacaugggaaauggcugcuuuaagaucuaccacaagugugauaacgccugcaucgggucuauuagaaauggcacauaugaccaugauguuuaccgcgacgaggcucugaacaaucgguuccagaucaaaggaguggaacucaaguccggcuacaaagacuggauucuguggaucagcuuugccauuucuugcuuccuucugugugucgcccuccugggguuuaucaugugggcuugccaaaagggaaacaucagauguaauauuugcaucuga

SEQ ID NO: 185597 - RNA, 1701 nt, Artificial Sequence; identical to SEQ ID NO: 185458
  derived and/or modified sequence opt5 from hemagglutinin__InfluenzaA__ACN43069

SEQ ID NO: 185598 - RNA, 1701 nt, Artificial Sequence; identical to SEQ ID NO: 185561
  derived and/or modified sequence opt5 from hemagglutinin__InfluenzaA__ACN43080

SEQ ID NO: 185599 - RNA, 1701 nt, Artificial Sequence
  derived and/or modified sequence opt5 from hemagglutinin__InfluenzaA__ACN72617
auggaggccaagcuguucgugcucuuuugcgcuuucaccgcccugaaagcggacacaaucugugucggcuaccacgcuaacaauagcacggauaccguugacacaauucuugaaaagaacgugaccgugacacauuccgucaaucugcucgagaacucucacaaugggaaacugugcagccuuaacggaaaggcuccccugcagcucggcaauuguaacguggccggguggauccugggaaauccugaaugcgaucugcuccugaccgccaacuccuggucuuauauuaucgagacaagcgacuccaaaaauggcgccuguuacccgggggaauuugcugauuaugaggagcuuagagaacaacugucuaccguuagcuccuucgagcgguuugaaauuuuccccaaggccacgagcuggccuaaccaugagaccacaaagggaaccacaguggcgugcucucacuccggcgccaauagcuuuuaccgcaaccuccuguggaucgucaaaaagggcaauucuuaucccaaacuuuccaagagcuacaccaacaacaaagggaaggaggugcugguuaucuggggagugcaucacccucccacggacucugaucagcagacacucuaucagaauaagcacaccuacgucuccgugggcagcuccaaauacuaucaaagauucacaccugaaauugugacccggccgaagguccgcgagcaggcugggagaaugaacuacuauuggacccugcuggaccagggagauacaaucacguuugaagccaccggcaaucucauugcucccuggcaugccuucgcgcugaacaaagggucuaauagcggaaucaugauguccgacgcccacguucauaacuguacaaccaagugccagacaccucacggcgcucuuaaaggcaaucugcccuuucaaaacgugcacccuauuaccaucggggagugucccaaguacgugaaaagcacgcagcuccggauggccacaggacugcgcaauauuccgucuauccaguccagaggccuuuucggggcuaucgccggauuuauugaaggcggguggaccggaaugaucgauggcugguauggcuaccaucaccagaacgagcaagggagcggauaugccgcugaccggaagucuacccagauugcgaucgauggcauuagcaauaaggucaacuccgugaucgagaaaaugaauauccaguucacaucuguugggaaggaguucaacaaucuggaaaaacgcauugaaaaccucaacaagaaaguggacgacggauuucuggaugucuggaccuacaaugccgagcugcucauccugcuugaaaacgagagaacacuggacuuccaugauuuuaaugugaagaaccucuacgagaagguuaaaagccaacugcggaauaacgcuaaggaaauuggcaaugggugcuucgaguuuuaucacaaaugugacaacgaaugcauggaguccgugaagaauggcacguacaacuauccucgcuacagcgaagagucuaaacuuaauagagaggaaaucgauggagucaagcuggaguccgugggcguccaucagauucucgccaucuauagcaccguggccucuucccugguucugcucgugagccugggggcuaucuccuucuggaugugcucuaacggaagccuucagugucggauuugcaucuga

SEQ ID NO: 185600 - RNA, 1701 nt, Artificial Sequence
  derived and/or modified sequence opt5 from hemagglutinin__InfluenzaA__ACN72632
augaagaccgugaucgcccugagcuacgucuucugccucguuuuuggccaggaccugcccgggaaaggaaacaauacagcuacgcuuugucugggccaccaugccgugccuaacgggacccucgugaagacaauuaccgaugaccaaaucgaggucacaaaugcgaccgaacuggugcagaacuucuccauuggaaaaaucugcaagaauccgcaccggauucuugauggcgcuaacuguacacugaucgacucucuccugggggauccccauugcgacggauuucagaaugagaaaugggaucuguucaucgaaagaagcaaggccuuuuccaacuguuauccuuacgacguucccgaguauaccucucuccgcagccugauugccuccucuggcacgcuugaguucaccaaugaagauuuuaacuggacaggcgugacccagaaugggggaagcuccgcuugcaagagaggcccuaacaauagcuucuuuucucggcugaacuggcucuacaaauccgggaauacauaucccaugcugaacgucaccaugccuaacagcgacgauuucgacaaacuuuacaucuggggagugcaccauccgucuacggaucgcgagcaaacaaaucuguauauucaggccuccggcaagaucauuguuagcaccaagagaucucagcagacaaucauucccaacaucgggucccggccuugggugcgcggacucagcuccagaaucucuauuuacuggaccaucgucaaacccggcgacauucugaucauuaauagcaacggcaaucugaucgcuccucggggguacuuuaagauccaaaccggaaaguccagcgugaugcgcucugacgcccccauuggcacauguaacuaugaaugcaucacgccgaauggguccauuccuaacgauaaacccuuccagaaugugaacagaaucaccuacggagcguguccucacuauauuaagcagaauacacucaaacuggccaccggcaugcggaacauccccgagcgccagacaagagggaucuuuggagcuauugccggcuucaucgaaaauggcugggaggggauggucaacggaugguacggcuuccggcaccaaaauagcgaggggauuggacaggcugccgaccuuaagucuacccaggcggccaucaaccaaauuaacggcaaacugaaucgcguuaucgaaaagacgaacgagaaauuucaucagauugaaaaggaguucagcgaaguggaggggagaauccaggaucucgagcgguauguggaagacacaaagaucgaucugugguccuacaaugcugagcuucuggucgcccucgaaaaccagcacaccauugaccugaccgauucugagaugaauaaacuguuugaaaagacaagaaaacaacuccgcgagaacgcugaggacaugggcaauggaugcuucaagaucuaucauaaaugugauaacagcugcauggaauccauucggaauggcaccuacgaccacaacgaguacagagaugaagccgugaauaaccgcuuucagaucaagagcguugagcugaagucuggguauaaagacuggauucuuuggaucuccuucgccaucagcugcuuucugcucugugcuguguggcugggauucauuaucugggcgugccagaagggcaauauucgguguaacaucugcauuuga

SEQ ID NO: 185601 - RNA, 1701 nt, Artificial Sequence; identical to SEQ ID NO: 185458
  derived and/or modified sequence opt5 from hemagglutinin__InfluenzaA__ACN76478

SEQ ID NO: 185602 - RNA, 1701 nt, Artificial Sequence
  derived and/or modified sequence opt5 from hemagglutinin__InfluenzaA__ACN76489
augaagaccaucauugcccugggcuacauccucugccuggugagcgcucagaaacuucccgggaacgacaauuccacagccacgcugugucucggacaccaugcggucccuaacggcaccauuguuaagacaaucaccaaugaucaaauugaggugacaaacgcuaccgaacuggugcagucuagcuccacaggggagaucugcgacucuccgcaccagguccuugauggagaaaauuguacccugaucgacgcccuccugggcgauccccagugcgacggguuccaaaacaaaaagugggaucuguuuguggagagaagcaaagccuauuccaauuguuacccuuaugacguucccgauuacgcuucucuccggagccugguggccuccagcggaacgcuugaguucaacaaugaaucuuuuaacuggaccggcgucacacagaauggcaccuccagcgcuugcauucgcagaucuaacaauuccuucuuuagccggcugaacuggcucacacaucugaaguucaaguauccugcccuuaaugugaccaugcccaacaacgaggaauuugacaaacuguacaucuggggaguucaccauccugggacggauaaugaccagauuuuccucuaugcgcaggccucuggccgcaucacaguguccaccaagagaagccaacagacagucauuccgaacaucgggucccggccccgcgugagaaauauuccuucucggaucagcaucuacuggaccauugugaaacccggagauauccugcugauuaacuccaccggcaaucucaucgcuccucgcggguacuuuaagauuagaagcggaaaaucuuccaucaugcggagcgacgcccccaucggcaaguguaacucugagugcauuacaccgaauggcagcaucccuaacgacaagcccuuccagaaugucaaccgcauuacguauggggcuuguccuagauacguuaaacagaauacccugaaacuugccacaggaaugcggaacgugcccgaaaaacaaacccgcggcaucuuuggggcgauugccggauucaucgagaauggcugggaggggaugguggauggaugguauggcuuuagacaccagaacuccgaaggcaucgggcaggcugccgaccugaagucuacacaagcugccauugaucagaucaauggaaaacucaaccggcugauuggcaagaccaacgagaaauuccaccagaucgaaaaggaguucagcgaagucgaggggcgcauucaggaccuugagaaguacguggaagauacgaaaaucgaccugugguccuauaaugccgagcuccugguugcucuggaaaaccaacauacaauugaucucaccgacagcgagaugaauaagcuguuugaaaagaccaagaaacagcuuagagagaacgcggaggauaugggaaauggcugcuucaagaucuaccacaagugugacaacgccugcaucgggucuauucggaauggcacauaugaucaugaaguguacagagacgaggcucugaacaaucgcuuucagaucaaaggagucgaacucaaguccggcuacaaagacuggauucuguggaucagcuucgccauuucuugcuuucuucuguguguggcccuccugggguucaucaugugggcuugccagaagggaaacauccgguguaauauuugcaucuga

SEQ ID NO: 185603 - RNA, 1701 nt, Artificial Sequence; identical to SEQ ID NO: 185458
  derived and/or modified sequence opt5 from hemagglutinin__InfluenzaA__ACN76500

SEQ ID NO: 185604 - RNA, 1701 nt, Artificial Sequence; identical to SEQ ID NO: 185458
  derived and/or modified sequence opt5 from hemagglutinin__InfluenzaA__ACN76511

SEQ ID NO: 185605 - RNA, 1701 nt, Artificial Sequence; identical to SEQ ID NO: 185458
  derived and/or modified sequence opt5 from hemagglutinin__InfluenzaA__ACN76522

SEQ ID NO: 185606 - RNA, 1701 nt, Artificial Sequence; identical to SEQ ID NO: 185458
  derived and/or modified sequence opt5 from hemagglutinin__InfluenzaA__ACO36331

SEQ ID NO: 185607 - RNA, 1701 nt, Artificial Sequence
  derived and/or modified sequence opt5 from hemagglutinin__InfluenzaA__ACO36342
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacagcgaaugcaucacaccgaauggcuccauuccuaacgacaagcccuuccagaaugugaaccgcaucacguauggcgcuuguccuagauacgucaagcagaauacccugaaacucgccacagggaugcggaacguucccgagaagcaaacccgcggaauuuuuggcgcgaucgccggguucaucgaaaauggaugggagggcaugguggaugggugguauggauucagacaccagaacucugagggcauuggccaggcugccgaccugaaaagcacacaagcugccaucgaucagauuaacgggaaacuuaaucggcugaucggaaagaccaacgaaaaguuucaccagauugagaaagaguucuccgaaaucgaaggccgcauucaggaccucgagaaguacguggaggauacgaagaucgaccuguggagcuauaaugccgaacuucuggucgcucucgagaaccaacauacaaucgaucugaccgacucugaaaugaauaaacuguuugagaagaccaaaaagcagcucagagaaaacgcggaggauauggggaauggaugcuucaaaauuuaccacaagugugacaacgccugcaucggcuccauucggaaugggacauaugaucaugacguguacagagacgaggcucugaacaaucgcuuucagaucaagggcguugaacuuaaaagcggauacaaggauuggauucuguggaucucuuucgccaucuccugcuuucuccuguguauugcccuucugggcuucaucaugugggcuugccagaaagggaacauucgguguaauaucugcauuuga

SEQ ID NO: 185608 - RNA, 1701 nt, Artificial Sequence
  derived and/or modified sequence opt5 from hemagglutinin__InfluenzaA__ACO36364
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagaaauucgacaagcuguacauuuggggcgugcaccauccugggacggauaaugaccagaucuuucucuaugcgcaggccucuggacgcauuacaguuuccaccaaaagaagccaacagacagugaucccgaacauuggcucccggccccgcgucagaaauaucccuucucggaucagcauuuacuggaccaucgugaagcccggggauauucugcugaucaacuccaccggaaaucucauugcuccucgcggcuacuucaaaaucagaagcgggaagucuuccaucaugcggagcgacgcccccauuggaaaguguaacucugaaugcaucacaccgaauggcagcauuccuaacgacaaacccuuucagaaugugaaccgcaucacguauggcgcuuguccuagauacgucaagcagaauacccugaaacuugccacagggaugcggaacguucccgagaagcaaacccgcggaauuuucggcgcgaucgccggguuuaucgaaaauggaugggagggcaugguggaugggugguauggauucagacaccagaacuccgagggcacaggccaggcugccgaccugaaaucuacccaagcugccauugaucagaucaaugggaagcucaaccggcugauuggaaaaacgaacgaaaaguuccaccagaucgagaaggaauuuagcgagguggaaggccgcauucaggaccuugagaaauacgucgaggauacaaagaucgaccugugguccuauaaugccgaacuccugguggcucuggagaaccaacauaccauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcguggaacucaaauccggauacaaggauuggauucuguggaucagcuuugccauuucuugcuuccuucugugugucgcccuccugggcuuuaucaugugggcuugccagaaagggaacauccgguguaauauuugcaucuga

SEQ ID NO: 185609 - RNA, 1701 nt, Artificial Sequence; identical to SEQ ID NO: 185325
  derived and/or modified sequence opt5 from hemagglutinin__InfluenzaA__ACO36375

SEQ ID NO: 185610 - RNA, 1698 nt, Artificial Sequence; identical to SEQ ID NO: 185512
  derived and/or modified sequence opt5 from hemagglutinin__InfluenzaA__ACO36397

SEQ ID NO: 185611 - RNA, 1701 nt, Artificial Sequence; identical to SEQ ID NO: 185325
  derived and/or modified sequence opt5 from hemagglutinin__InfluenzaA__ACO36408

SEQ ID NO: 185612 - RNA, 1701 nt, Artificial Sequence; identical to SEQ ID NO: 184952
  derived and/or modified sequence opt5 from hemagglutinin__InfluenzaA__ACO36419

SEQ ID NO: 185613 - RNA, 1701 nt, Artificial Sequence; identical to SEQ ID NO: 184952
  derived and/or modified sequence opt5 from hemagglutinin__InfluenzaA__ACO36430

SEQ ID NO: 185614 - RNA, 1701 nt, Artificial Sequence
  derived and/or modified sequence opt5 from hemagglutinin__InfluenzaA__ACO36441
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcgcuugcaagcgcagaucuaauaaguccuuuuucagccggcugaacuggcucacacaucugaaauauaaguacccugcccuuaaugucaccaugcccaacaaugagaaauuugauaagcuguauaucuggggagugcaccauccugggacggacucugaucagauuucccucuacgcgcaggccagcggccgcaucacaguuuccaccaaaagaucucaacagacagugauuccgaacaucgggagccggccccgcgucagagacguguccagccggauuucuaucuacuggaccaucgugaagccuggagacauucugcugaucaacuccaccggcaaucucauugcuccccgcggguauuucaagaucagaagcggaaaaucuagcauuaugcgguccgaugccccuaucggcaaguguaacucugagugcaucacacccaauggcagcauuccgaacgacaaaccuuuucagaaugucaaccgcaucacguacggggcuugucccagauauguuaagcagaauacccugaaacuugccacaggaaugcggaacgugccugaaaagcaaacccgcggcauuuucggggcgaucgccggauuuauugagaauggcugggaagggaugguggauggaugguacggcuucagacaccagaacuccgagggcacagggcaggcugccgaccugaaaagcacccaagcugccaucaaucagaucaacggaaagcucaaucggcugauuggcaagacgaacgagaaauuucaccagaucgaaaaggaguucucugaagucgaggggcgcauucaggaucuugaaaaauauguggaggacacaaagaucgaucugugguccuacaaugccgagcuccugguugcucuggaaaaccaacauaccauugaccucaccgauagcgagaugaacaaacuguucgaaagaacaaagaagcagcuucgggagaaugcggaagacaugggaaacggcugcuuuaaaaucuaucacaagugugauaaugccugcauugggucuaucagaaacggcaccuacgaccaugacguguaccgcgaugaggcucugaauaaccgguuccagaucaaaggagucgagcucaaguccggcuauaaagacuggauucuguggaucagcuuugccauuuccugcuuccuucuguguguggcccuccugggguuuaucaugugggcuugccagaagggaaauauuagaugugauaucugcaucuga

SEQ ID NO: 185615 - RNA, 1701 nt, Artificial Sequence
  derived and/or modified sequence opt5 from hemagglutinin__InfluenzaA__ACO36452
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcucuugcaagcgcagauccaauaacagcuuuuucucucggcugaauuggcucacacaucugaaguauaaauacccugcucuuaacgucaccaugcccaauaacgagaaguuugauaaacuguauaucuggggagugcaccauccugggacggacuccgaucagauuagccucuacgcccaggcguccggccgcaucacaauuucuaccaagagaagccaacagacaguuaucccgaacauugggucccggccccgcgugagagacgucagcucucggaucuccaucuacuggaccauugugaaaccuggagacauccugcugauuaauagcaccggcaaccucaucgcuccccgcggguauuucaagauuagaucuggaaagagcuccaucaugcggucugaugccccuaucggcaaauguaauagcgagugcauuacacccaacggcuccaucccgaaugacaagccuuuucagaacgugaaucgcauuacguacggggccugucccagauaugucaaacagaacacccugaaacuugcuacaggaaugcggaauguuccugaaaaacaaacccgcggcaucuucggggccauugcgggauuuaucgagaacggcugggaagggaugguggauggaugguacggcuucagacaccagaauagcgagggcacagggcaggccgcugaccugaagucuacccaagccgcuaucaaccagauuaauggaaaacucaaccggcugaucggcaagacgaaugagaaguuucaccagauugaaaaagaguucuccgaaguggaggggagaauccaggaucuugaaaaguaugucgaggacacaaaaauugaucuguggagcuacaacgccgagcuccugguggcccuggaaaaccaacauaccaucgaccucaccgauucugagaugaauaagcuguucgaacgcacaaagaagcagcuucgggagaacgcugaagacaugggaaauggcugcuuuaagauuuaucacaaaugugauaacgcgugcaucggguccaucagaaauggcaccuacgaccaugacguuuaccgcgaugaggcccugaacaaucgguuccagauuaagggaguggagcucaaaagcggcuauaaggacuggauccuguggauuuccuuugcuaucucuugcuuccuucugugugucgcccuccugggguuuauuaugugggccugccagaaaggaaacaucagauguaauaucugcauuuga

SEQ ID NO: 185616 - RNA, 1701 nt, Artificial Sequence
  derived and/or modified sequence opt5 from hemagglutinin__InfluenzaA__ACO36463
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucaucgaaagaagcaaagccuauuccaauuguuacccuuaugacguccccgauuacgcuucucuccggagccugguggccuccagcggaacgcuugaguuuaacaaugaaucuuucaacuggaccggcguuacacagaauggcaccuccagcgcuugccagcgcagaucuaacaaguccuuuuucagccggcugaauuggcucacacaucugaaguuuaaauauccugcccuuaacgugaccaugcccaauaacgagaaguucgacaaacuguacauuuggggaguccaccauccugggacggauaacgaccagaucucucucuaugcgcaaacauccggccgcauuaccgugagcacaaagagaucccagcagaccguuaucccgaauauugggucucggccccgcgugagagaugucccuagccggaucuccaucuacuggaccauugugaaacccggagacauccugcugauuaacagcacaggcaaucucaucgccccucgcggguacuuuaagauuagaucuggaaaguccagcaucaugcggucugacgcucccaucggcaaauguaacagcgagugcauuacgccgaauggcuccaucccuaacgauaagcccuuccagaaugugaaccgcauuaccuauggggccuguccuagauacgucaaacaaaauacacugaagcuggcuaccggaaugcggaacguucccgaacgccagacaagaggcaucuuuggggccauugcgggauucaucgagaauggcugggaagggaugguggacggaugguauggcuuucggcaccagaacucugagggcaccgggcaagccgcugaucuuaaaagcacgcaggccgcuaucaaucagauuaacggaaagcucaauagacugaucggcaaaacaaacgagaaguuccaccagauugaaaaggaguucuccgaaguggaggggcgcauccaagaccuugaaaaauacgucgaggauaccaagauugaccuguggagcuauaacgccgagcuccugguggcccuggaaaaucagcauaccaucgaucucacagacucugagaugaacaaacuguuugaacggaccaagaaacagcuuagagagaaugcugaagauaugggaaacggcugcuucaagauuuaccacaagugugacaaugcgugcaucggguccauccgcaacggcacauaugaucaugacguuuaccgggacgaggcccugaauaacagauuucagauuaaaggaguggagcucaagagcggcuacaaagauuggauccuguggauuucuuucgcuaucuccugcuuuguccuuuguguggcccugcucggguucauuaugugggccugccaaaagggaaauauccgcuguaacaucugcauuuga

SEQ ID NO: 185617 - RNA, 1701 nt, Artificial Sequence
  derived and/or modified sequence opt5 from hemagglutinin__InfluenzaA__ACO36474
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcucuugcaagcgcagauccaauaacagcuuuuucucucggcugaauuggcucacacaucugcgcuauaaguacccugcucuuaacgucaccaugcccaauaacgagaaauuugauaagcuguauaucuggggagugcaccauccugggacggacuccgaucagauuagccucuacgcccaggcguccggcagaaucacaguuucuaccaaacggagccaacagacagugauuccgaacaucgggucccgccccagaguccgggacgugagcucucgcauuuccaucuacuggaccaucgugaagccuggagacauucugcugaucaauagcaccggcaaccucauugcccccagaggguauuucaaaauccggucuggaaagagcuccauuaugcgcucugaugcuccuaucggcaaguguaauagcgagugcaucacacccaacggcuccauuccgaaugacaaaccuuuucagaacgucaauagaaucacguacggggauuguccccgguauguuaagcagaacacccugaaacuugccacaggaaugcgcaaugugccugaaaagcaaaccagaggcauuuucggggcuaucgccggauuuauugagaacggcugggaagggaugguggacggaugguacggcuuccggcaccagaauagcgagggcacagggcaggcggccgaucugaaaucuacccaagcugccaucaaccagaucaauggaaagcucaacagacugauuggcaaaacgaaugagaaguuucaccagaucgaaaaggaguucuccgaagucgaggggcgcauucaggaccuugaaaaauauguggaggauacaaagaucgaccuguggagcuacaacgcugagcuccugguugcccuggaaaaccaacauaccauugaucucaccgacucugagaugaauaaacuguucgaacggacaaagaaacagcuuagagagaacgccgaagauaugggaaauggcugcuuuaagaucuaucacaagugugacaacgcuugcauuggguccauccgcaauggcaccuacgaccaugauguguaccgggacgaggcgcugaacaauagauuccagaucaaaggagucgagcucaagagcggcuauaaagauuggauucuguggaucuccuuugccauuucuugcuuccuucuguguguggcucuccugggguuuaucaugugggccugccagaagggaaacauucgcuguaauaucugcaucuga

SEQ ID NO: 185618 - RNA, 1701 nt, Artificial Sequence
  derived and/or modified sequence opt5 from hemagglutinin__InfluenzaA__ACO36496
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauggguuuuucucccggcugaacuggcucacacaucugaaguuuaaauauccugcccuuaaugucaccaugcccaacaacgagaaguucgacaaacuguacaucuggggagugcaccauccuggcacggauaaugaccagauuagccucuaugcgcaggccucugggcgcaucacaguuuccaccaagagaagccaacagacagugauuccgaacaucggaucccggccccgcgucagagauauuucuagccggaucuccaucuacuggaccauugugaaaccuggcgacauccugcugauuaauagcaccgggaaccucaucgcuccccgcggauacuuuaagauuagaucuggcaaguccagcaucaugcggucugacgccccuaucggcaaauguaauagcgagugcauuacacccaacggguccaucccgaaugauaagccuuuccagaacgugaaucgcauuacguauggagcuugucccagauacgucaaacagaacacccugaagcuggccacaggcaugcggaauguuccugaaacccaaacacgcgggaucuuuggagcgauugccggcuucaucgagaacgggugggaaggaaugguggacggcugguauggcuuuagacaccaaaauucugaggggaccggacaggcugccgaucuuaaaagcacgcaggcugccaucaaccagauuaauggcaagcucaaccggcugaucgggaaaacaaacgagaaguuccaccagauugaaaaggaguucuccgaaguggagggaagaauccaggaccuugaaaaauacgucgaggauaccaagauugaccuguggagcuauaaugccgagcuccugguggcucuggaaaaccaacauaccaucgaucucacagacucugagaugaauaaacuguuugaacgcaccaagaaacagcuucgggagaacgcggaagauaugggcaaugggugcuucaagauuuaccacaagugugacaacgccugcaucggcuccaucagaaauggaacauaugaucaugacguuuaccgcgacgaggcucugaacaaucgguuucagauuaaaggcguggagcucaagagcggguacaaagauuggauccuguggauuucuuucgccaucuccugcuuucuucugugugucgcccuccugggauucauuaugugggcuugccagaagggcaacaucagauguaauaucugcauuuga

SEQ ID NO: 185619 - RNA, 1701 nt, Artificial Sequence
  derived and/or modified sequence opt5 from hemagglutinin__InfluenzaA__ACO36518
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuaagaucagaucuggaaaauccagcauuaugcggucugacgcccccaucggcaaguguaacagcgagugcaucacaccgaauggcuccauuccuaacgauaaacccuuccagaaugucaaccgcaucacguaugggaccuguccuagauacguuaagcagaauacacugaaacuugcuaccggaaugcggaacgugcccgaaaagcaaacacgcggcauuuuuggggccaucgcgggauucauugagaauggcugggaagggaugguggacggaugguauggcuuuagacaccagaacucugagggcaccgggcaggccgcugaucugaaaagcacgcaagccgcuaucaaucagaucaacggaaagcucaaucggcugauuggcaagacaaacgagaaauuccaccagaucgaaaaggaguucuccgaagucgaggggcgcauucaggaccuugaaaaauacguggaggauaccaagaucgaccuguggagcuauaacgccgagcuccugguugcccuggaaaaucaacauaccauugaucucacagacucugagaugaacaaacuguuugaaagaaccaagaagcagcuucgggagaaugcugaagauaugggaaacggcugcuucaaaaucuaccacaagugugacaaugcgugcauuggguccaucagaaacggcacauaugaucaugacguguaccgcgacgaggcccugaauaaccgguuucagaucaaaggagucgagcucaagcugggcuacaaagauuggauucuuuggaucagcuucgcuauuucuugcuuucugcucuguguggcccugcugggguucaucaugugggccugccagaagggaaauauuagauguaacaucugcaucuga

SEQ ID NO: 185620 - RNA, 1701 nt, Artificial Sequence
  derived and/or modified sequence opt5 from hemagglutinin__InfluenzaA__ACO36551
augaagaccaucauugcccugagccacauccucugccugguguucgcucagaaacccccuggcaacgacaauuccacagccacgcuuugucuggggcaucacgcggucccgaacggaaccauuguuaagacaaucaccaaugaucaaauugaggugacaaacgcuaccgaacucgugcagucuagcuccacaggcgggaucugcgacucuccccaucagauccuggauggagagaauuguacccuuauugacgcccugcucggcgauccucagugcgacggguuucaaaacaaaaagugggaucuguucgucgaaagaagcaaagccuacuccaauuguuaucccuacgacgugccugauuaugcuucucugcggagccucguugccuccagcggaacgcuggaguuuaacaaugaaucuuucaacuggaccggcgugacacagaauggcaccuccagcgcuugcaagcgcagaucuaacaauuccuuuuucagccggcuuaacuggcugacacaccucaaguuuaaauaccccgcccugaaugucaccaugccuaacaacgagaaguucgacaaacuuuauaucuggggagugcaucacccggggacggauaaugaccagauuucucuguacgcgcaggccuccggccgcaucacaguuagcaccaagagaucccaacagacagugauucccaacaucgggucucggccucgcgucagagauauuagcucccggaucagcaucuauuggaccauugugaaacccggagacauccuccugauuaauucuaccggcaaccugaucgcuccucgcggguacuuuaagauuagauccggaaagagcucuaucaugcggagcgacgcccccaucggcaaauguaauuccgagugcauuacaccgaacggcucuaucccuaaugauaagcccuuccagaacgugaaucgcauuacguacggggcuuguccuagauaugucaaacagaacacccucaagcuggccacaggaaugcggaauguucccgaaacccaaacacgcggcaucuuuggggcgauugccggauucaucgagaacggcugggaagggaugguggacggaugguacggcuuuagacaccagaauagcgagggcaccgggcaggcugccgaucuuaaauccacgcaagcugccaucaaccagauuaauggaaagcugaaccggcucaucggcaaaacaaacgagaaguuccaucagauugaaaaggaguucagcgaaguggaggggagaauccaggaccuggaaaaauaugucgaggauaccaagauugaccuuuggucuuacaaugccgagcugcucguggcucuggaaaaccaacacaccaucgaucugacagacuccgagaugaauaaacucuuugaacgcaccaagaaacagcugcgggagaacgcggaagauaugggaaauggcugcuucaagauuuaucauaagugugacaacgccugcaucgggagcaucagaaaugagacauacgaucacgacguuuaucgcgacgaggcucuuaacaaucgguuucagauuaaaggcguggaacugaagucuggauacaaagauuggauccucuggauuuccuucgccaucagcugcuuucugcuuugugucgcccugcucggcuucauuaugugggcuugccagaaggggaacaucagauguaauaucugcauuuga

SEQ ID NO: 185621 - RNA, 1701 nt, Artificial Sequence
  derived and/or modified sequence opt5 from hemagglutinin__InfluenzaA__ACO36562
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaacccaaacacgcggcaucuuuggggcgauugccggauucaucgagaacggcugggaagggaugguggacggaugguauggcuuuagacaccaaaauucugagggcaccgggcaggcugccgaucuuaaaagcacgcaggcugccaucaaccagauuaauggaaagcucaaccggcugaucggcaaaacaaacgagaaguuccaccagauugaaaaggaguucuccgaaguggaggggagaauccaggaccuugaaaaauacgucgaggauaccaagauugaccuguggagcuauaaugccgagcuccugguggcucuggaaaaccaacauaccaucgaucucacagacucugagaugaauaaacuguuugaacgcaccaagaaacagcuucgggagaacgcggaagauaugggaaauggcugcuucaagauuuaccacaagugugacaacgccugcaucggguccaucagaaaugagacauaugaucaugacguuuaccgcgacgaggcucugaacaaucgguuucagauuaaaggcguggaacucaagagcggauacaaagauuggauccuguggauuucuuucgccaucuccugcuuucuucugugugucgcccuccugggcuucauuaugugggcuugccagaaggggaacaucagauguaauaucugcauuuga

SEQ ID NO: 185622 - RNA, 1701 nt, Artificial Sequence
  derived and/or modified sequence opt5 from hemagglutinin__InfluenzaA__ACO36573
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuagcucccggaucagcaucuacuggaccauugugaaaccuggagacauccugcugauuaauucuaccggcaaccucaucgcuccccgcggguacuuuaagauuagauccggaaagagcucuaucaugcggagcgacgccccuaucggcaaauguaauuccgagugcauuacacccaacggcucuaucccgaaugauaagccuuuccagaacgugaaucgcauuacguauggggcuugucccagauacgucaaacagaacacccugaaacuugccacaggaaugcggaauguuccugaaacccaaacacgcggcaucuuuggggcgauugccggauucaucgagaacggcugggaagggaugguggacggaugguauggcuuuagacaccagaauagcgagggcaccgggcaggcugccgaucugaaguccacgcaagcugccaucaaccagauuaauggaaagcucaaccggcugaucggcaaaacaaacgagaaguuccaccagauugaaaaggaguucagcgaaguggaggggagaauccaggaccuugaaaaauacgucgaggauaccaagauugaccuguggucuuauaaugccgagcuccugguggcucuggaaaaccaacauaccaucgaucucacagacuccgagaugaauaaacuguuugaacgcaccaagaaacagcuucgggagaacgcggaagauaugggaaauggcugcuucaagauuuaccacaagugugacaacgccugcaucgggagcaucagaaaugagacauaugaucaugacguuuaccgcgacgaggcucugaacaaucgguuucagauuaaaggcguggaacucaagucuggauacaaagauuggauccuguggauuuccuucgccaucagcugcuuucuucugugugucgcccuccugggcuucauuaugugggcuugccagaaggggaacaucagauguaauaucugcauuuga

SEQ ID NO: 185623 - RNA, 1701 nt, Artificial Sequence
  derived and/or modified sequence opt5 from hemagglutinin__InfluenzaA__ACO36584
augaagaccaucauugcccugagcuacauccucugccugguguucucccagaaacuucccggcaacgacaauucuacagcuacgcugugucucgggcaccaugccgucccuaacggaaccauuguuaagacaaucaccaaugaucaaauugaggugacaaacgcgaccgaacuggugcagagcuccucuacaggcgggaucugcgacagcccgcaccagauccuugauggagagaauuguacccugauugacgcucuccugggcgauccccagugcgacggguuucaaaacaaaaagugggaucuguucgucgaaagauccaaagccuauucuaauuguuacccuuaugacgugcccgauuacgccagccuccggucccugguugcuagcucuggaacgcuugaguuuaacaaugaauccuucaacuggaccggcgugacacagaauggcaccagcucugccugcaagcgcagauccaacaauagcuuuuucucucggcugaacuggcucacacaucugaaguuuaaauauccugcucuuaaugucaccaugcccaacaacgagaaguucgacaaacuguacaucuggggagugcaccauccugggacggauaaugaccagauuucccucuaugcccaggcgagcggccgcaucacaguuuccaccaagaaaucucaacagacagugauuccgaacaucgggagcagaccccggguccgcgauauuuccagcagaaucucuaucuacuggaccauugugaagccuggagacauccugcugauuaauuccaccggcaaccucaucgcuccccggggguacuuuaagauucgcagcggaaaaucuagcaucaugagauccgacgccccuaucggcaaguguaauucugagugcauuacacccaacggcagcaucccgaaugauaaaccuuuccagaacgugaaucggauuacguauggggccuguccccgcuacgucaagcagaacacccugaaacuugcuacaggaaugagaaauguuccugaaacccaaacacggggcaucuuuggggccauugcgggauucaucgagaacggcugggaagggaugguggacggaugguauggcuuucgccaccagaauagcgagggcaccgggcaggccgcugaucugaaguccacgcaagccgcuaucaaccagauuaauggaaaacucaacagacugaucggcaagacaaacgagaaguuccaccagauugaaaaagaguucucugaaguggaggggcggauccaggaccuugaaaaguacgucgaggauaccaaaauugaccugugguccuauaaugccgagcuccugguggcccuggaaaaccaacauaccaucgaucucacagacagcgagaugaauaagcuguuugaaagaaccaaaaagcagcuucgcgagaacgcugaagauaugggaaauggcugcuucaagauuuaccacaaaugugacaacgcgugcaucgggucuauccggaaugagacauaugaucaugacguuuacagagacgaggcccugaacaaucgcuuucagauuaagggcguggaacucaaauccggauacaaggauuggauccuguggauuagcuucgcuaucuccugcuuucuucugugugucgcccuccugggcuucauuaugugggccugccagaaagggaacauccgguguaauaucugcauuuga

SEQ ID NO: 185624 - RNA, 1701 nt, Artificial Sequence; identical to SEQ ID NO: 183654
  derived and/or modified sequence opt5 from hemagglutinin__InfluenzaA__ACO36595

SEQ ID NO: 185625 - RNA, 1701 nt, Artificial Sequence
  derived and/or modified sequence opt5 from hemagglutinin__InfluenzaA__ACO36606
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaagaacgaaucuuucaauuggaccggcgugacacagaacggcaccuccagcgcuugcaagcgcagaucuaauaacuccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuuuucucuaugcgcaggccucuggccgcaucacaguuuccacccaaagaagccagcagacagugauuccgaauaucgggucccggccccgcgucagaaacauuccuucucggaucagcaucuacuggaccauugugaaacccggagauauccugcugauuaauuccaccggcaaccucaucgcuccucgcggguacuucaagauuagaagcggaaagucuuccaucaugcggagcgacgcccccaucggcaaauguaauucugagugcauuacaccgaacggcagcaucccuaaugacaagcccuuucagaacgugaaucgcauuacguauggggcuuguccuagauacgucaaacaaaacacccugaaacuugccacaggaaugcggaauguucccgaaaagcagacccgcggcaucuucggggcgauugccggauuuaucgagaacggcugggaagggaugguggauggaugguauggcuucagacaccaaaauuccgagggcaucgggcaggcugccgaccugaagucuacacaggcugccauuaaccagaucaauggaaaacucaaccggcugauuggcaagaccaacgagaaguuccaccagaucgaaaaagaguuuagcgaaguggaggggcgcauucaagaucuugaaaaguacgucgaggacacgaaaaucgaucugugguccuauaaugccgagcuccugguggcucuggaaaaccagcauacaauugaccucaccgauagcgagaugaauaagcuguucgaaagaaccaaaaagcagcuucgggagaacgcggaagacaugggaaauggcugcuuuaagaucuaccacaaaugugauaacgccugcaucgggucuauuagaaauggcacauaugaccaugauguuuaccgcgacgaggcucugaacaaucgguuccagaucaagggaguggagcucaaauccggcuacaaggacuggauucuguggaucagcuuugccauuucuugcuuccuucugugugucgcccuccugggguuuaucaugugggcuugccaaaaaggaaacaucagauguaauauuugcaucuga

SEQ ID NO: 185626 - RNA, 1701 nt, Artificial Sequence; identical to SEQ ID NO: 183654
  derived and/or modified sequence opt5 from hemagglutinin__InfluenzaA__ACO36617

SEQ ID NO: 185627 - RNA, 1701 nt, Artificial Sequence; identical to SEQ ID NO: 183654
  derived and/or modified sequence opt5 from hemagglutinin__InfluenzaA__ACO36628

SEQ ID NO: 185628 - RNA, 1701 nt, Artificial Sequence
  derived and/or modified sequence opt5 from hemagglutinin__InfluenzaA__ACO36639
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacacgaaaaucgaucugugguccuauaacgccgagcuccugguggcucuggaaaaucaacauacaauugaccucaccgauagcgagaugaacaagcuguucgaaagaaccaaaaagcagcuucgggagaaugcggaagacaugggaaacggcugcuuuaagaucuaccacaaaugugauaaugccugcaucgggucuauuagaaacggcacauaugaccaugauguuuaccgcgacgaggcucugaauaaccgguuccagaucaagggaguggagcucaaauccggcuacaaggacuggauucuguggaucagcuuugccauuucuugcuuccuucuguguuuugcccuccugggguucaucaugugggcuugccagaaaggaaauaucagauguaacauuugcaucuga

SEQ ID NO: 185629 - RNA, 1701 nt, Artificial Sequence
  derived and/or modified sequence opt5 from hemagglutinin__InfluenzaA__ACO36661
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguacgucgaggacaucaaaauugaucugugguccuauaacgccgagcuccugguggcucuggaaaaucaacauacgaucgaccucacagauagcgagaugaacaagcuguucgaaagaaccaaaaagcagcuucgggagaaugcggaagacaugggaaacggcugcuuuaagaucuaccacaaaugugauaaugccugcauugggucuaucagaaacggcaccuaugaccaugauguuuaccgcgacgaggcucugaauaaccgguuccagauuaagggaguggagcucaaauccggcuacaaggacuggauccuguggauuagcuuugccaucucuugcuuccuucugugugucgcccuccugggguuuaucaugugggcuugccagaaaggaaauauuagauguaacaucugcauuuga

SEQ ID NO: 185630 - RNA, 1701 nt, Artificial Sequence; identical to SEQ ID NO: 183654
  derived and/or modified sequence opt5 from hemagglutinin__InfluenzaA__ACO36683

SEQ ID NO: 185631 - RNA, 1701 nt, Artificial Sequence; identical to SEQ ID NO: 185621
  derived and/or modified sequence opt5 from hemagglutinin__InfluenzaA__ACO37122

SEQ ID NO: 185632 - RNA, 1701 nt, Artificial Sequence
  derived and/or modified sequence opt5 from hemagglutinin__InfluenzaA__ACO94514
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcaagucuaacaauuccuuuuucagcagacugaacuggcucacacaucugaaguuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaaacgcagccagcagacagugaucccgaacauuggcuccagaccccggguccgcaauaucccuucuagaaucagcauuuacuggaccaucgugaagcccggggauauucugcugaucaacuccaccggaaaucucauugcuccucggggcuacuucaaaauccgcagcgggaagucuuccaucaugagaagcgacgcccccauuggaaaguguaacucugaaugcaucacaccgaauggcagcauuccuaacgacaaacccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugguggaugggugguauggauuccgccaccagaacuccgagggcagaggccaagcugccgaccugaaaucuacacaggcugccauugaucagaucaaugggaagcucaaccggcugauuggaaaaaccaacgaaaaguuccaccagaucgagaaggaauuuagcgagguggaaggccgcauucaagaccuugagaaauacgucgaggauacgaagaucgaccugugguccuauaaugccgaacuccugguggcucuggagaaccagcauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcguggaacucaaauccggauacaaggauuggauucuguggaucagcuuugccauuucuugcuuccuucugugugucgcccuccugggcuuuaucaugugggcuugccaaaaagggaacauccgguguaauauuugcaucuga

SEQ ID NO: 185633 - RNA, 1701 nt, Artificial Sequence
  derived and/or modified sequence opt5 from hemagglutinin__InfluenzaA__ACO94515
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcaagucuaacaauuccuuuuucagcagacugaacuggcucacacaucugaaguuuaaauauccugcccuuaaugucaccaugcccaacaacgagcaguucgacaagcuguacauuuggggcgugcaccauccugggacggauaaugaccagaucuuucucuaugcgcaagccucuggacggauuacaguuuccaccaaacgcagccagcagacagugaucccgaacauuggcuccagaccccggguccgcaauaucccuucuagaaucagcauuuacuggaccaucgugaagcccggggauauucugcugaucaacuccaccggaaaucucauugcuccucggggcuacuucaaaauccgcagcgggaagucuuccaucaugagaagcgacgcccccauuggaaaguguaacucugaaugcaucacaccgaauggcagcauuccuaacgacaaacccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugauggaugggugguauggauuccgccaccagaacuccgagggcagaggccaagcugccgaccugaaaucuacacaggcugccauugaucagaucaaugggaagcucaaccggcugauuggaaaaaccaacgaaaaguuccaccagaucgagaaggaauuuagcgagguggaaggccgcauucaagaccuugagaaauacguggaggauacgaagaucgaccugugguccuauaaugccgaacuccuggucgcucuggagaaccagcauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguguacagagacgaggcucugaacaaucgcuuccagaucaagggcguugaacucaaauccggauacaaggauuggauucuguggaucagcuuugccauuucuugcuuccuucuguguguggcccuccugggcuuuaucaugugggcuugccaaaaagggaacauccgguguaauauuugcaucuga

SEQ ID NO: 185634 - RNA, 1701 nt, Artificial Sequence; identical to SEQ ID NO: 185458
  derived and/or modified sequence opt5 from hemagglutinin__InfluenzaA__ACO94516

SEQ ID NO: 185635 - RNA, 1701 nt, Artificial Sequence; identical to SEQ ID NO: 185458
  derived and/or modified sequence opt5 from hemagglutinin__InfluenzaA__ACO94672

SEQ ID NO: 185636 - RNA, 1701 nt, Artificial Sequence
  derived and/or modified sequence opt5 from hemagglutinin__InfluenzaA__ACO94683
augaagaccaucauugcccugagcuacauccucugccugguguccgcucagaaacuucccggcaacgacaauucuacagccacgcugugucucgggcaccaugcggucccuaacggaaccauuguuaagacaaucaccaaugaucaaauugaggugacaaacgcuaccgaacuggugcagagcuccucuacaggcgagaucugcgacagcccgcaccagguccuugauggggaaaauuguacccugaucgacgcccuccugggagauccccagugcgacggcuuccaaaacaaaaagugggaucuguuuguggagagauccaaagccuauucuaauuguuacccuuaugacguucccgauuacgcuagccuccggucccugguggccagcucugggacgcuugaguucaacaaugaauccuuuaacuggaccggagucacacagaauggcaccagcucugcuugcauucgcagauccaacaauagcuucuuuucucggcugaacuggcucacacauuccaaguucaaguauccugcccugaaugugaccaugcccaacaacgaggaauuugacaaacuuuacaucuggggcguucaccauccugggacggauaaugaccagauuuuccuguaugcgcaggccagcggacgcaucacaguguccaccaagagaucucaacagacagucauuccgaacaucggcagccggccccgcgugagaaauauuccuucccggaucagcaucuacuggaccauugugaaacccggggauauccuccugauuaacucuaccggaaaucugaucgcuccucgcggcuacuuuaagauuagauccgggaaaagcucuaucaugcggagcgacgcccccaucggaaaguguaacuccgagugcauuacaccgaauggcucuaucccuaacgacaagcccuuccagaaugucaaccgcauuacguauggcgcuuguccuagauacguuaaacagaauacccucaagcuggccacagggaugcggaacgugcccgaaaaacaaacccgcggaaucuuuggcgcgauugccggguucaucgagaauggaugggagggcaugguggaugggugguauggauuuagacaccagaacagcgaaggcaucggccaggcugccgaccuuaaguccacacaagcugccauugaucagaucaaugggaaacugaaccggcucauuggaaagaccaacgagaaauuccaccagaucgaaaaggaguucacggaagucgagggccgcauucaggaccuggagaaguacguggaagauacaaaaaucgaccuuuggagcuauaaugccgagcugcucguugcucuggaaaaccaacauaccauugaucugaccgacucugagaugaauaagcucuuugaaaagacaaagaaacagcugagagagaacgcggaggauauggggaauggaugcuucaagaucuaccacaagugugacaacgccugcaucggcuccauucggaaugggaccuaugaucaugaaguguacagagacgaggcucuuaacaaucgcuuucagaucaaaggcgucgaacugaaaagcggauacaaagacuggauucucuggaucucuuucgccauuuccugcuuucugcuuuguguggcccugcucggcuucaucaugugggcuugccagaaggggaacauccgguguaauauuugcaucuga

SEQ ID NO: 185637 - RNA, 1701 nt, Artificial Sequence; identical to SEQ ID NO: 185458
  derived and/or modified sequence opt5 from hemagglutinin__InfluenzaA__ACO94694

SEQ ID NO: 185638 - RNA, 1698 nt, Artificial Sequence; identical to SEQ ID NO: 185512
  derived and/or modified sequence opt5 from hemagglutinin__InfluenzaA__ACO94705

SEQ ID NO: 185639 - RNA, 1701 nt, Artificial Sequence
  derived and/or modified sequence opt5 from hemagglutinin__InfluenzaA__ACO94727
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugaaaagcgacgcccccauuggaaaguguaacucugaaugcaucacaccgaauggcagcauuccuaacgacaagcccuuucagaaugugaaccggaucacguauggcgcuuguccucgcuacgucaagcaaaauacccugaaacuugccacagggaugagaaacguucccgagaagcagacccggggaauuuucggcgcgaucgccggguuuaucgaaaauggaugggagggcaugguggaugggugguauggauuccgccaccagaacuccgagggcagaggccaagcugccgaccugaaaucuacacaggcugccauugaucagaucaaugggaagcucaaccggcugauuggaaaaaccaacgaaaaguuccaccagaucgagaaggaauuuagcgagguggaaggccgcauucaagaccuugagaaauacgucgaggauacgaagaucgaccugugguccuauaaugccgaacuccugguggcucuggagaaccagcauacaauugaucucaccgacagcgaaaugaauaaacuguucgagaagaccaaaaagcagcuuagagaaaacgcggaggauauggggaauggaugcuuuaagaucuaccacaaaugugacaacgccugcaucggcucuauucggaaugggacauaugaucaugacguuuacagagacgaggcucugaacaaucgcuuccagaucaagggcguggaacucaaauccggauacaaggauuggauucuguggaucagcuuugccauuucuugccuucugcucugugucgcccugcugggcuucaucaugugggcuugccaaaaagggaacauccgguguaauauuugcaucuga

SEQ ID NO: 185640 - RNA, 1701 nt, Artificial Sequence
  derived and/or modified sequence opt5 from hemagglutinin__InfluenzaA__ACO94738
augaagaccaucauugcccugagcuacauccagugccucguguucgcucaaaaauuucccggcaacgacaauuccacagccacgcugugucuugggcaccaugcggucccuaacggaaccguugugaagacaauuaccaaugaucagaucgaggugacaaacgcuaccgaacugguccagucuagcuccacaggcgagauuugcgacucuccgcaccagauccucgauggggaaaauuguacccugaucgacgcccuucugggagauccccaaugcgacggcuuccagaacaaaaauugggaucucuuuguggagagaagcaaggccuauuccaacuguuacccuuaugacguucccgauuacgcuucucugcggagccugguggccuccagcgggacgcucgaguucaauaacgaaucuuuuaauuggaccggagucacacagaacggcaccuccagcgcuugcauucgcagaucuaauaacuccuucuuuagccggcugaauuggcuuacacauucuaaauucaaguauccugcccugaacgugaccaugcccaacaaugagaacuuugacaagcucuacaucuggggcguucaccauccugggacggauaaugaccagauuuuccuguaugcgcgcgccuccggaagaaucacagugagcaccaaacggucccaacagacagucauuccgaacaucggcucucgccccagagugcggaauauuccuagccgcaucuccaucuacuggaccauugugaagcccggggauauccuucugauuaacagcaccggaaaucucaucgcuccuagaggcuacuuuaaaauucggucugggaaguccagcaucaugcgcucugacgcccccaucggaaaauguaacagcgaaugcauuacaccgaauggcuccaucccuaacgacaagcccuuccagaaugucaacagaauuacguauggcgcuuguccucgguacguuaagcagaauacccugaaacuggccacagggaugcgcaacgugcccgagaagcaaaccagaggaaucuuuggcgcgauugccggguucaucgaaaauggaugggagggcaugguggaugggugguauggauuccggcaccagaacucugagggcaucggccaggcugccgaccucaaaagcacacaagcugccauugaucagaucaacgggaagcugaauagacuuauuggaaaaaccaacgaaaaguuucaccagaucgagaaagaguucuccgaagucgaaggccgcauucaggaccuggagaaguacguggaggauacgaagaucgaccucuggagcuauaaugccgaacugcuuguugcucuggagaaccaacauacaauugaucucaccgacucugaaaugaauaaacuguuugagaagaccaaaaagcagcugcgggaaaacgcggaggauauggggaauggaugcuucaaaaucuaccacaagugugacaacgccugcaucggcuccauuagaaaugggacauaugaucaugacguguaccgcgacgaggcucucaacaaucgguuucagaucaagggcgucgaacugaaaagcggauacaaggauuggauucuuuggaucucuuucgccauuuccugcuuucugcucuguaucgcccugcuuggcuucaucaugugggcuugccagaaagggaacauuagauguaauaucugcauuuga

SEQ ID NO: 185641 - RNA, 1701 nt, Artificial Sequence; identical to SEQ ID NO: 185561
  derived and/or modified sequence opt5 from hemagglutinin__InfluenzaA__ACO94760

SEQ ID NO: 185642 - RNA, 1701 nt, Artificial Sequence
  derived and/or modified sequence opt5 from hemagglutinin__InfluenzaA__ACO94771
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccagaucaaaggcguggaacucaaguccggauacaaagauuggauucuguggaucagcuuugccauuucuugccuucugcucugugucgcccugcugggcuucaucaugugggcuugccaaaaggggaacaucagauguaauauuugcaucuga

SEQ ID NO: 185643 - RNA, 1701 nt, Artificial Sequence; identical to SEQ ID NO: 185458
  derived and/or modified sequence opt5 from hemagglutinin__InfluenzaA__ACO94782

SEQ ID NO: 185644 - RNA, 1701 nt, Artificial Sequence; identical to SEQ ID NO: 185458
  derived and/or modified sequence opt5 from hemagglutinin__InfluenzaA__ACO94793

SEQ ID NO: 185645 - RNA, 1698 nt, Artificial Sequence
  derived and/or modified sequence opt5 from hemagglutinin__InfluenzaA__ACO94804
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccagagagucuuggagcuacauuguggaaaaaccgaaucccgagaacggcaccuguuauccugggcauuuugccgacuacgaggaacugcgggagcaacucuccucugucagcuccuucgaacgcuuugagaucuuccccaaggagagcucuuggccuaaucacacgaccacaggaguguccgccagcugcucucauaacggcgaauccagcuuuuauaagaaucugcuuuggcugaccggcaaaaacgggcucuaccccaaucugucuaaguccuaugcuaacaauaaagagaaggaaguucuggugcucuggggaguccaccacccuccgaacaucggcaaccagagagcccuguaccauacagagaaugcuuacgugagcguggucuccucucacuauagccggaaauucacccccgaaauugccaagcgcccuaagguuagagaucaggaggggcggaucaacuacuauuggacgcuucuggagcccggagacacaauuaucuuugaagcgaauggcaaccucauugccccucgcuacgcuuucgcccuguccagaggguuuggaagcggcaucauuaauucuaacgcucccauggauggcugugacgccaaaugccagaccccgcaaggggcgaucaauuccagccuuccuuuccagaacgugcaucccgugacaaucggagaguguccuaaguauguccggucugccaaacugcgcauggugaccggccucagaaauauucccagcauccagucccgggggcuguuuggagcuauugccggcuucaucgaagggggauggaccggcaugguugauggcugguacggguaucaccaccagaacgagcaaggaucuggcuacgcugccgaccaaaagagcacacagaaugccauuaacgggaucacgaauaaagugaacuccgucaucgaaaagaugaauacccaguuuacagcugugggaaaagaguucaacaagcuggagcgcagaauggaaaaccucaauaagaaaguugaugacggcuucauugauaucuggaccuacaacgcggagcugcuugugcugcucgaaaaugagcggacacuggacuuucaugacagcuaugucaagaaccuuuacgaaaaagugaagucucagcugaaaaauaacgccaaggagauugggaauggcugcuucgaguuuuaucacaaguguaacgaugaaugcauggaguccgucaaaaauggaaccuacgacuaucccaaguacagcgaagagucuaaacucaaccgcgagaagaucgauggcgugaaacuggaauccauggggguuuaucagauucuggcuaucuacagcacgguggccuccucucucguccugcuugugagccugggagccaucuccuucuggaugugcucuaauggcagccuccaguguagaauuugcaucuga

SEQ ID NO: 185646 - RNA, 1701 nt, Artificial Sequence; identical to SEQ ID NO: 185325
  derived and/or modified sequence opt5 from hemagglutinin__InfluenzaA__ACO94815

SEQ ID NO: 185647 - RNA, 1701 nt, Artificial Sequence; identical to SEQ ID NO: 185332
  derived and/or modified sequence opt5 from hemagglutinin__InfluenzaA__ACO94848

SEQ ID NO: 185648 - RNA, 1698 nt, Artificial Sequence; identical to SEQ ID NO: 185512
  derived and/or modified sequence opt5 from hemagglutinin__InfluenzaA__ACO94859

SEQ ID NO: 185649 - RNA, 1698 nt, Artificial Sequence
  derived and/or modified sequence opt5 from hemagglutinin__InfluenzaA__ACO94870
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaaggaaaggaggugcugguccucuggggcgugcaccacccuccgaacaucggggaccagaauacccuguaccauacagaaaacgccuacgugagcgucguuuccucucacuauagcagaaaauucacccccgagauugcuaagcggccuaaggugcgcgaucaggaaggaagaaucaauuacuauuggacgcuucuggagcccggcgacacaauuaucuuugaggccaacgggaaucucauugcgccucgguacgccuucgcucugaaccgcggauuuggcuccggcaucauuaauagcaacgcccccauggauaaaugugacgcuaagugccagaccccgcaaggggccaucaauucuucccuuccuuuccagaacgugcaucccgucacaaucggagaauguccuaaauaugugagaagcgcgaagcugcggaugguuaccggccuccgcaauauucccucuauccagagcagagggcuguuuggagccauugcuggcuucaucgaagggggauggaccggcaugguggauggcugguacggguaucaccaccagaacgaacaaggauccggcuacgccgcugaccagaaaucuacacagaaugccauuaacgggaucacgaauaaggucaacagcgugaucgagaaaaugaacacccaguuuacagccguuggaaaggaguucaauaagcuggagcggcgcauggagaaccucaauaaaaagguggaugacggcuucauugauaucuggaccuacaacgcugaacugcuuguccugcucgagaaugaaagaacacuggacuuucaugacuccaacgugaaaaaucuuuaugagaaggucaaaagccaacugaagaacaaugcgaaggaaauugggaacggcugcuucgaguuuuaccacaaauguaaugaugagugcauggaaucugugaagaacggaaccuaugacuaccccaaauauuccgaggaaagcaagcucaaucgggagaaaaucgauggcguuaagcuggagucuauggggguguaccagauucuggccaucuauuccacggucgcuagcucccucgugcugcuuguuucucugggagccaucagcuucuggaugugcuccaacggcucucuccagugucgcauuugcaucuga

SEQ ID NO: 185650 - RNA, 1701 nt, Artificial Sequence
  derived and/or modified sequence opt5 from hemagglutinin__InfluenzaA__ACO94881
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcucuugcaagcgcagauccaauaacagcuuuuucucucggcugaauuggcucacacaucugaaguauaaauacccugcucuuaacgucaccaugcccaauaacgagaaguuugauaaacuguauaucuggggagugcaccauccugggacggacuccgaucagauuagccucuacgcccaggcguccggccgcaucacaguuucuaccaagagaagccaacagacagugauuccgaacaucgggucccggccccgcgucagagacgugagcucucggauuuccaucuacuggaccaucgugaaaccuggagacauucugcugaucaauagcaccggcaaccucauugcccccagaggguauuucaagaucagaucuggaaagagcuccauuaugcggucugaugcuccuaucggcaaauguaauagcgagugcaucacacccaacggcuccauuccgaaugacaagccuuuucagaacgucaaucgcaucacguacggggccugucccagauauguuaaacagaacacccugaaacuugcuacaggaaugcggaaugugccugaaaaacaaacccgcggcauuuucggggccaucgcgggauuuauugagaacggcugggaagggaugguggauggaugguacggcuucagacaccagaauagcgagggcacagggcaggccgcugaccugaagucuacccaagccgcuaucaaccagaucaauggaaaacucaaccggcugauuggcaagacgaaugagaaguuucaccagaucgaaaaagaguucuccgaagucgaggggcgcauucaggaucuugaaaaguauguggaggacacaaaaaucgaucuguggagcuacaacgccgagcuccugguugcccuggaaaaccaacauaccauugaccucaccgauucugagaugaauaagcuguucgaacgcacaaagaagcagcuucgggagaacgcugaagacaugggaaauggcugcuuuaagaucuaucacagaugugauaacgcgugcauuggguccauccgcaauggcaccuacgaccaugacguguaccgggaugaggcccugaacaauagauuccagaucaaaggagucgagcucaagagcggcuauaaagacuggauucuguggaucuccuuugcuauuucuugcuuccuucuguguguggcccuccugggguuuaucaugugggccugccagaagggaaacauucgcuguaauaucugcaucuga

SEQ ID NO: 185651 - RNA, 1701 nt, Artificial Sequence
  derived and/or modified sequence opt5 from hemagglutinin__InfluenzaA__ACO94892
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugccagcgcagaucuaacaaguccuuuuucagccggcugaauuggcucacacaucugaaguuuaaauauccugcccuuaacgucaccaugcccaauaacgagaaguucgacaaacuguacaucuggggagugcaccauccugggacggauaacgaccagauuucucucuaugcgcaaacauccggccgcaucaccauuagcacaaagagaucccagcagaccguuaucccgaauauugggucucggccccgcgugagagaugucccuagccggaucuccaucuacuggaccauugugaaacccggagacauccugcugauuaacagcacaggcaaucucaucgccccucgcggguacuuuaagauuagaucuggaaaguccagcaucaugcggucugacgcucccaucgugaaauguaacagcgagugcauuacgccgaauggcuccaucccuaacgauaagcccuuccagaaugucaaccgcauuaccuauggcgccuguccuagauacguuaaacaaaauacacugaagcuggcuaccgggaugcggaacgugcccgaacgccagacaagaggaaucuuuggcgccauugcgggguucaucgagaauggaugggaaggcaugguggacgggugguauggauuucggcaccagaacucugagggcaccggccaagccgcugaucuuaaaagcacgcaggccgcuaucaaucagauuaacgggaagcucaauagacugaucggaaaaacaaacgagaaguuccaccagauugaaaaggaguucuccgaagucgagggccgcauccaagaccuugaaaaauacguggaggauaccaagauugaccuguggagcuauaacgccgagcuccugguugcccuggaaaaucagcauaccaucgaucucacagacucugagaugaacaaacuguuugaacggaccaagaaacagcuuagagagaaugcugaagauauggggaacggaugcuucaagauuuaccacaagugugacaaugcgugcaucggcuccauccgcaacgggacauaugaucaugacguguaccgggacgaggcccugaauaacagauuucagauuaaaggcgucgagcucaagagcggauacaaagauuggauccuguggauuucuuucgcuaucuccugcuuucuucuguguguggcccuccugggcuucauuaugugggccugccaaaaggggaauauccgcuguaacaucugcauuuga

SEQ ID NO: 185652 - RNA, 1701 nt, Artificial Sequence
  derived and/or modified sequence opt5 from hemagglutinin__InfluenzaA__ACO94903
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcgaggccuauuccaauuguuacccuuaugacgugcccgauuacgcuucucuccggagccugguugccuccagcggaacgcuugaauuuaacaaugagucuuucaacuggaccggcgugacacagaauggcaccuccagcgcuugcaaacgcagaucuaacaaguccuuuuucagccggcugaauuggcucacacaucugaaguuuaaauauccugcccuuaacgucaccaugcccaauaacgagaaguucgacaaacuguacaucuggggagugcaccauccugggacggauaacgaccagauuucucucuaugcgcaggccuccggccgcaucacaguuagcaccaagagaucccaacagacagugauuccgaauaucgggucucggccccgcgucagagaugugccuagccggauuuccaucuacuggaccaucgugaaacccggagacauucugcugaucaacagcaccggcaaucucauugcuccucgcggguacuuuaagaucagaucuggaaaguccagcauuaugcggucugacgcccccaucggcaaauguaacagcgaaugcaucacaccgaauggcuccauuccuaacgauaagcccuuccagaaugucaaccgcaucacguauggggcuuguccuagauacguuaaacagaauacccugaaacuugccacaggaaugcggaacgugcccgagaaacaaacccgcggcauuuuuggggcgaucgccggauucauugaaaauggcugggaggggaugguggacggaugguauggcuuuagacaccagaacucugagggcacagggcaggcugccgaucucaagagcacccaagcugccaucaaucagaucaacggaaaacugaaucggcugauuggcaagacgaacgaaaaguuccaccagaucgagaaagaguucuccgaagucgaagggcgcauucaggaccuugagaaguacguggaggauacaaaaaucgaccuguggagcuauaacgccgaacuccugguugcucuggagaaucaacauaccauugaucucaccgacucugaaaugaacaagcuguuugagagaacaaagaagcagcuucgggaaaaugcggaggauaugggaaacggcugcuucaagaucuaccacaaaugugacaaugccugcauuggguccaucagaaacggcaccuaugaucaugacguguaccgcgacgaggcucugaauaaccgguuucagaucaagggagucgaacucaaaagcggcuacaaggauuggauucuguggaucucuuucgccauuuccugcuuucuucuguguguggcccuccugggguucaucaugugggcuugccagaaaggaaauauuagauguaacaucugcaucuga

SEQ ID NO: 185653 - RNA, 1701 nt, Artificial Sequence
  derived and/or modified sequence opt5 from hemagglutinin__InfluenzaA__ACO94925
augaagaccaucauugcccugagcuacauccucugccugguguucgcucagaaacuucccggcaacgacaauuccacagccacgcugugucucgggcaccaugcggucccuaacggaaccguugugaagacaauuaccaaugaucaaaucgaggugacaaacgcuaccgaacugguccagucuagcuccacaggcgggauuugcgacucuccgcaccagauccuugauggagagaauuguacccugaucgacgcccuccugggcgauccccagugcgacggguuucaaaacaaaaagugggaucuguucguggaaagaagcaaagccuauuccaauuguuacccuuaugacguucccgauuacgcuucucuccggagccugguggccuccagcggaacgcuugaguuuaacaaugaaucuuucaacuggaccggcgucacacagaauggcaccuccagcgcuugcaagcgcagaucuaacaaguccuuuuucagccggcugaauuggcucacacaucugaaauuuaaguauccugcccuuaacgugaccaugcccaauaacgagaaauucgacaagcuguacauuuggggaguucaccauccugggacggauaacgaccagaucucucucuaugcgcaggccuccggccgcauuacagugagcaccaaaagaucccaacagacagucaucccgaauauugggucucggccccgcgugagagaugugccuagccggaucuccauuuacuggaccaucgucaagcccggagacauccugcugauuaacagcaccggcaaucucaucgcuccucgcggguacuuuaagauuagaucuggaaaauccagcaucaugcggucugacgcccccauuggcaaguguaacagcgagugcaucacaccgaauggcuccaucccuaacgauaaacccuuccagaauguuaaccgcauuacguauggggcuuguccuagauacgugaagcagaauacccugaaacuugccacaggaaugcggaacgugcccgaaaagcaaacccgcggcaucuuuggggcgauugccggauucaucgagaauggcugggaagggauggucgacggaugguauggcuuuagacaccagaacucugagggcacagggcaggcugccgaucugaaaagcacccaagcugccauuaaucagaucaacggaaagcucaaucggcugaucggcaagacgaacgagaaauuccaccagauugaaaaggaguucuccgaaguggaggggagaauccaggaccuugaaaaauacguugaggauacaaagauugaccuguggagcuauaacgccgagcuccugguggcucuggaaaaucaacauaccaucgaucucaccgacucugagaugaacaaacuguuugaacgcacaaagaagcagcuucgggagaaugcggaagauaugggaaacggcugcuucaaaauuuaccacaagugugacaaugccugcaucggguccauuagaaacggcaccuaugaucaugacgucuaccgcgacgaggcucugaauaaccgguuucagaucaaaggaguggagcucaagagcggcuacaaagauuggauccuguggauuucuuucgccaucuccugcuuucuucuguguguugcccuccugggguucauuaugugggcuugccagaagggaaauaucagauguaacauuugcaucuga

SEQ ID NO: 185654 - RNA, 1701 nt, Artificial Sequence
  derived and/or modified sequence opt5 from hemagglutinin__InfluenzaA__ACO94936
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagaggacuguacccugauugaugcccuccugggcgacccccagugcgauggguuucaaaauaaaaagugggaccuguucgucgaaagaagcaaagccuauuccaacuguuacccuuaugaugugcccgacuacgcuucucuccggagccugguugccuccagcggaacgcuugaguuuaauaacgaaucuuucgauuggaccggcgugacacagaauggcaccuccagcucuugcaagcgcagauccaacaauagcuuuuucucucggcugaacuggcucacacaucugaaguauaaauacccugcucuuaaugucaccaugcccaacaaugagaaguuugacaaacuguauaucuggggagugcaccauccugggacggauuccgaccagauuagccucuacgcccaggcguccggccgcaucacaguuucuaccaagagaagccaacagacagugauuccgaacaucgggucccggccccgcgucagagacgugagcucucggauuuccaucuacuggaccaucgugaaaccuggagauauucugcugaucaacagcaccggcaaucucauugcccccagaggguauuucaagaucagaucuggaaagagcuccauuaugcggucugacgcuccuaucggcaaauguaacagcgagugcaucacacccaauggcuccauuccgaacgauaagccuuuucagaaugucaaccgcaucacguacggggccugucccagauauguuaaacagaauacccugaaacuugcuacaggaaugcggaacgugccugaaaaacaaacccgcggcauuuucggggccaucgcgggauuuauugagaauggcugggaagggaugguggacggaugguacggcuucagacaccagaacagcgagggcacagggcaggccgcugaucugaagucuacccaagccgcuaucaaucagaucaacggaaaacucaaucggcugauuggcaagacgaacgagaaguuucaccagaucgaaaaagaguucuccgaagucgaggggcgcauucaggaccuugaaaaguauguggaggauacaaaaaucgaccuguggagcuacaaugccgagcuccugguugcccuggaaaaccaacauaccauugaucucaccgacucugagaugaacaagcuguucgaacgcacaaagaagcagcuucgggagaaugcugaagauaugggaaacggcugcuuuaagaucuaucacaaaugugacaaugcgugcauuggguccaucagaaacggcaccuacgaccaugauguguaccgcgacgaggcccugaauaaccgguuccagaucaagggagucgagcucaaaagcggcuauaaggauuggauucuguggaucuccuuugcuauuucuugcuuccuucuguguguggcccuccugggguuuaucaugugggccugccagaaaggaaauauuagauguaacaucugcaucuga

SEQ ID NO: 185655 - RNA, 1701 nt, Artificial Sequence
  derived and/or modified sequence opt5 from hemagglutinin__InfluenzaA__ACO94947
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgugaagcccggagacauucugcugaucaacagcaccggcaaucucauugcuccucgcggguacuuuagaauccggucuggaaaguccagcauuaugcgcucugacgcccccaucggcaaauguaacagcgagugcaucacaccgaauggcuccauuccuaacgauaagcccuuccagaaugucaacagaaucacguauggggcuuguccucgguacguuaaacagaauacccugaaacuugccacaggaaugcgcaacgugcccgaaaaacaaaccagaggcauuuuuggggcgaucgccggauucauugagaauggcugggaagggaugguggacggaugguauggcuuucggcaccagaacucugagggcacagggcaggcugccgaucucaagagcacccaagcugccaucaaucagaucaacggaaaacugaauagacugauuggcaagacgaacgagaaguuccaccagaucgaaaaagaguucuccgaagucgaggggcgcauucaggaccuugaaaaguacguggaggauacaaaaaucgaccuguggagcuauaacgccgagcuccugguugcucuggaaaaucaacauaccauugaucucaccgacucugagaugaacaagcuguuugaacggacaaagaagcagcuuagagagaaugcggaagauaugggaaacggcugcuucaagaucuaccacaaaugugacaaugccugcauuggguccauccgcaacggcaccuaugaucaugacguguaccgggacgaggcucugaauaacagauuucagaucaagggagucgagcucaaaagcggcuacaaggauuggauucuguggaucucuuucgccauuuccugcuuucuucuguguguggcccuccugggguucaucaugugggcuugccagaaaggaaauauucgcuguaacaucugcaucuga

SEQ ID NO: 185656 - RNA, 1701 nt, Artificial Sequence
  derived and/or modified sequence opt5 from hemagglutinin__InfluenzaA__ACO95153
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaauuucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagauauuagcucccggaucagcaucuacuggaccauugugaagccuggagacauccugcugauuaacucuaccggcaaucucaucgcuccccgcggguacuuuaaaauuagauccggaaagagcucuaucaugcggagcgacgccccuaucggcaaguguaacuccgagugcauuacacccaauggcucuaucccgaacgauaaaccuuuccagaaugugaaccgcauuacguauggggcuugucccagauacgucaagcagaauacccugaaacuugccacaggaaugcggaacguuccugaaacccaaacacgcggcaucuuuggggcgauugccggauucaucgagaauggcugggaagggaugguggacggaugguauggcuuuagacaccagaacagcgagggcaccgggcaggcugccgaucugaaguccacgcaagcugccaucaaucagauuaacggaaaacucaaccggcugaucggcaagacaaaugagaaauuccaccagauugaaaaggaguucagcgaaguggaggggagaauccaggaccuugaaaaguacgucgaggauaccaaaauugaccuguggucuuauaacgccgagcuccugguggcucuggaaaaucaacauaccaucgaucucacagacuccgagaugaacaagcuguuugaacgcaccaaaaagcagcuucgggagaaugcggaagauaugggaaacggcugcuucaaaauuuaccacaagugugacaaugccugcaucgggagcaucagaaacggcacauaugaucaugacguuuaccgcgacgaggcucugaauaaccgguuucagauuaagggaguggagcucaaaucuggcuacaaggauuggauccuguggauuuccuucgccaucagcugcuuucuucugugugucgcccuccugggguucauuaugugggcuugccagaaaggaaauaucagauguaacaucugcauuuga

SEQ ID NO: 185657 - RNA, 1701 nt, Artificial Sequence; identical to SEQ ID NO: 185622
  derived and/or modified sequence opt5 from hemagglutinin__InfluenzaA__ACO95171

SEQ ID NO: 185658 - RNA, 1701 nt, Artificial Sequence
  derived and/or modified sequence opt5 from hemagglutinin__InfluenzaA__ACO95193
augaagaccaucauugcccugagcuacauccucugccugguguucgcucagaaacuucccggcaacgacaaguccacagccacgcugugucucgggcaccaugcggucccuaauggaaccauuguuaaaacaaucaccaacgaucaaauugaggugacaaaugcuaccgaacuggugcagucuagcuccacaggcgggaucugcgacucuccgcaccagauccuugauggagagaacuguacccugauugacgcccuccugggcgauccccagugcgacggguuucaaaauaagaaaugggaucuguucgucgaaagaagcaaggccuauuccaacuguuacccuuaugacgugcccgauuacgcuucucuccggagccugguugccuccagcggaacgcuugaguuuaauaacgaaaauuucaacuggaccggcgugacacagaauggcaccucuuccgcuugcaagcgcagaagcaacaauuccuuuuucucucggcugaacuggcucacacaucugaaauuuaaguauccugcccuuaaugucaccaugcccaacaacgagaaauucgacaagcuguacaucuggggagugcaccauccugggacggauaaugaccagauuagccucuaugcgcaggccucuggccgcaucacaguuuccaccaaaagaagccaacagacagugauuccgaacaucgggucccggccccgcgucagagauauuucuagccggaucuccaucuacuggaccauugugaagccuggagacauccugcugauuaauagcaccggcaaccucaucgcuccccgcggguacuuuaagauuagaucuggaaaauccagcaucaugcggucugacgccccuaucggcaaguguagcuccgagugcauuacacccaauggcucuaucccgaacgauaaaccuuuccagaaugugaaccgcauuacguauggggcuugucccagauacgucaagcagaauacccugaaacuugccacaggaaugcggaacguuccugaaacccaaacacgcggcaucuuuggggcgauugccggauucaucgagaauggcugggaagggaugguggacggaugguauggcuuuagacaccagaacagcgagggcaccgggcaggcugccgaucugaaguccacgcaagcugccaucaaucagauuaacggaaaacucaaucggcugaucggcaagacaaacgagaaguuccaccagauugaaaaagaguucagcgaaguggaggggagaauccaggaccuugaaaaguacgucgaggauaccaaaauugaccuguggucuuauaacgccgagcuccugguggcucuggaaaaucaacauaccaucgaucucacagacuccgagaugaacaagcuguuugaacgcaccaaaaagcagcuucgggagaaugcggaagauaugggaaacggcugcuucaagauuuaccacaaaugugacaaugccugcaucgggagcaucagaaacggcacauaugaucaugacguuuaccgcgacgaggcucugaauaaccgguuucagauuaagggaguggagcucaaaucuggcuacaaggauuggauccuguggauuuccuucgccaucagcugcuuucuucugugugucgcccuccugggguucauuaugugggcuugccagaaaggaaauaucagauguaacaucugcauuuga

SEQ ID NO: 185659 - RNA, 1701 nt, Artificial Sequence; identical to SEQ ID NO: 185621
  derived and/or modified sequence opt5 from hemagglutinin__InfluenzaA__ACO95204

SEQ ID NO: 185660 - RNA, 1701 nt, Artificial Sequence
  derived and/or modified sequence opt5 from hemagglutinin__InfluenzaA__ACO95215
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguccaccauccugggacggauaaugaccagaucucucucuaugcgcaggccuccggccgcauuacagugagcaccaagagaucccaacagacaguuaucccgaacauugggucucggccccgcgugagagauaucagcucccggaucagcauuuacuggaccaucgucaaaccuggagacauucugcugaucaauucuaccggcaaccucauugcuccccgcggguacuuuaagaucagauccggaaagagcucuaucaugcggagcgacgccccuauuggcaaauguaauuccgagugcaucacacccaacggcucuauuccgaaugauaagccuuuccagaacgugaaucgcaucacguauggggcuugucccagauacgugaaacagaacacccugaaacuugccacaggaaugcggaaugucccugaaacccaaacacgcggcauuuuuggggcgaucgccggauucaucgagaacggcugggaagggaugguugacggaugguauggcuuuagacaccagaauagcgagggcaccgggcaggcugccgaucugaaguccacgcaagcugccauuaaccagaucaauggaaagcucaaccggcugauuggcaaaacaaacgagaaguuccaccagaucgaaaaggaguucagcgaaguggaggggcgcauucaggaccuugaaaaauacguggaggauaccaagaucgaccuguggucuuauaaugccgagcuccuggucgcucuggaaaaccaacauaccauugaucucacagacuccgagaugaauaaacuguuugaaagaaccaagaaacagcuucgggagaacgcggaagauaugggaaauggcugcuucaagaucuaccacaagugugacaacgccugcaucgggagcauuagaaaugagacauaugaucaugacguguaccgcgacgaggcucugaacaaucgguuucagaucaaaucuguugaacucaaguccggcuacaaagauuggauucuguggaucagcuucgccauuuccugcuuucuucuguguguggcccuccugggauucaucaugugggcuugccagaagggcaacaucagauguaauauuugcaucuga

SEQ ID NO: 185661 - RNA, 1701 nt, Artificial Sequence; identical to SEQ ID NO: 183305
  derived and/or modified sequence opt5 from hemagglutinin__InfluenzaA__ACO95226

SEQ ID NO: 185662 - RNA, 1701 nt, Artificial Sequence; identical to SEQ ID NO: 183654
  derived and/or modified sequence opt5 from hemagglutinin__InfluenzaA__ACO95248

SEQ ID NO: 185663 - RNA, 1701 nt, Artificial Sequence
  derived and/or modified sequence opt5 from hemagglutinin__InfluenzaA__ACO95270
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgagaucugcgacucuccgcaccagauccuugauggggaaaauuguacgcugauugacgcucuccugggagauccccagugcgacggcuuucaaaacaaaaagugggaucuguucgucgagagaagcaaagccuauuccaauuguuacccuuaugacgugcccgauuacgccucucuccggagccugguugcuuccagcgggacccuugaauuuaacaaugagucuuucaacuggacaggagugacccagaauggcacauccagcgccugcauccgcagaucuaacaauuccuuuuucagccggcugaacuggcucacccaucugaaguuuaaguauccugcucuuaaugucacgaugcccaacaacgagaaauucgacaagcuguacauuuggggcgugcaccauccuguuacagauaauaaccagaucuuucucuaugcccaggcgucugggcgcauuaccguguccacaaaaagaagccaacagaccgucaucccgaauauuggaucccggccccgcgugagaaacaucccuucucggaucagcauuuacuggaccaucgugaagcccggcgacauucugcugaucaauuccacagggaaccucauugccccucgcggauacuucaaaaucagaagcggcaagucuuccaucaugcggagcgaugcucccauugggaaguguaauucugaaugcaucacgccgaacggaagcauuccuaaugacaaacccuuucagaacgucaaucgcaucaccuauggcgccuguccuagauacguuaagcagaacacacugaaacuugcuaccggcaugcggaaugugcccgagaagcaaacacgcgggauuuucggagccaucgcgggcuuuaucgaaaacgggugggagggaaugguggacggcugguauggguucagacaccaaaauuccgagggaauuggccaggccgcugaucugaaaucuacccaggccgcuaucgaccagauuaacggcaagcucaaccggcugaucgggaaaacgaaugaaaaguuccaccagauugagaaggaauuuagcgaggucgaaggaagaauccaggaucuugagaaauacguggaggacacaaagauugaucugugguccuauaacgccgaacuccugguugcccuggagaaucaacauaccaucgaccucaccgauagcgaaaugaacaaacuguucgagaagaccaaaaagcagcuucgcgaaaaugcugaggacaugggcaacgggugcuuuaagaucuaccacaaaugugauaaugcgugcauuggaucuauccggaacggcacauaugaccaugauguguacagagacgaggcccugaauaaccgcuuccagauuaagggggucgaacucaaauccggcuacaaggacuggauccuguggauuagcuuugcuaucucuugcuuccuucuguguguggcccuccugggauuuaucaugugggccugccagaaaggcaauauucgguguaacaucugcauuuga

SEQ ID NO: 185664 - RNA, 1701 nt, Artificial Sequence; identical to SEQ ID NO: 185458
  derived and/or modified sequence opt5 from hemagglutinin__InfluenzaA__ACO95281

SEQ ID NO: 185665 - RNA, 1701 nt, Artificial Sequence
  derived and/or modified sequence opt5 from hemagglutinin__InfluenzaA__ACO95292
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagauccagagcgggaaaucuuccaucaugagaagcgacgcccccauuggaaaguguaacucugaaugcaucacaccgaauggcagcauuccuaacgacaagcccuuucaaaaugugaaccggaucacguauggcgcuuguccucgcuacgucaaacagaauacccugaaacuugccacagggaugagaaacguucccgagaagcagacccggggaauuuucggcgcgaucgccggguuuaucgaaaauggaugggagggcaugguggaugggugguauggauuccgccaccaaaacuccgagggcagaggccaggcugccgaccugaagucuacacaggcugccauugaucagaucaaugggaaacucaaccggcugauuggaaagaccaacgaaaaauuccaccaaaucgagaaggaauuuagcgagguggaaggccgcauucaggaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuuagagaaaacgcggaggauauggggaauggaugcuuuaagaucuaccacaagugugacaacgccugcaucggcucuauucggaaugggacauaugaucaugacguuuacagagacgaggcucugaacaaucgcuuccaaaucaaaggcguggaacucaaguccggauacaaagauuggauucuguggaucagcuuugccauuucuugcuuccuucugugugucgcccuccugggcuuuaucaugugggcuugccagaaggggaacauccgguguaauauuugcaucuga

SEQ ID NO: 185666 - RNA, 1701 nt, Artificial Sequence; identical to SEQ ID NO: 185561
  derived and/or modified sequence opt5 from hemagglutinin__InfluenzaA__ACO95303

SEQ ID NO: 185667 - RNA, 1698 nt, Artificial Sequence
  derived and/or modified sequence opt5 from hemagglutinin__InfluenzaA__ACO95382
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagggaagcuggccuaaccacacggugaccggcguuucugccuccugcagccauaauggcgaaucuuccuuuuaucgcaaccugcuuuggcugacagggaaaaauggacucuaccccaaccugagcaagucuuaugcuaauaacaaagagaaggaagugcugguccucuggggcgugcaccacccuccgaacaucggggaccagaaagcccuguaccauaccgagaaugcuuacguguccgucguuagcucccacuauucuagaaaguucacacccgaaauugccaagcggccuaaagugcgcgaucaggagggaagaaucaacuacuauuggacccuucuggagcccggcgacacgauuaucuuugaagcgaaugggaaccucauugccccucgguacgcuuucgcccugagccgcggauuuggcuccggcaucauuaauagcaacgcucccauggauaagugugacgccaaaugccagacaccgcaaggggcgaucaauucuucccuuccuuuccagaacgugcaucccgucaccaucggagaguguccuaaguaugugagaagcgccaaacugcggaugguuacaggccuccgcaauauucccucuauccagagcagagggcuguuuggagcuauugccggcuucaucgaagggggauggaccggcaugguggauggcugguacggguaucaccaccagaacgagcaaggauccggcuacgcugccgaccagaagucuacccagaaugccauuaacgggaucacaaauaaagucaacagcgugaucgaaaagaugaauacgcaguuuaccgcuguuggaaaggaguucaacaaacuggagcggcgcauggaaaaccucaauaagaaaguggaugacggcuucauugauaucuggacauacaacgcggagcugcuuguccugcucgaaaaugagagaacccuggacuuucaugacuccaacgugaagaaucuuuaugaaaaagucaagagccaacugaagaacaaugccaaagagauugggaacggcugcuucgaguuuuaccacaaguguaaugaugaaugcauggagucugugaaaaacggaacauaugacuaccccaaguauuccgaagagagcaaacucaaucgggagaagaucgauggcguuaagcuggaaucuauggggguguaccagauucuggcuaucuauuccaccgucgccagcucccucgugcugcuuguuucucugggagccaucagcuucuggaugugcuccaacggcucucuccagugucgcauuugcaucuga

SEQ ID NO: 185668 - RNA, 1698 nt, Artificial Sequence
  derived and/or modified sequence opt5 from hemagglutinin__InfluenzaA__ACO95415
augaaggugaaacugcucguccugcuuugcaccuucacagccacguacgcugacaccaucuguauuggcuaucacgccaacaauagcacagauaccaucgacacaguucuggagaagaacgugaccgugacacauuccgucaaucuccuggaaaacucucacaaugggaaacuuugccugcucaagggaauugcgccccugcagcugggcaacuguagcguggcuggguggauccucggaaauccugagugcgaacugcuuauuuccaaagagucuuggagcuacaucguugaaaagccgaaccccgagaauggcaccuguuauccugggcauuuugccgauuacgaggaacugagagagcaacucuccucugugagcuccuucgaacgguuugagaucuuccccaaggagagcucuuggccuaaccacacggucaccggaguguccgccagcugcucucauaauggcgaauccagcuuuuaucgcaaccugcuuuggcugacaggcaaaaaugggcucuaccccaaccugucuaaguccuaugcuaauaacaaaggaaaggagguucuggugcucuggggcguccaccacccuccgaacauuggggaccagaauacccuguaccauacagaaaacgccuacgugagcguggucuccucucacuauagcagaaaauucacccccgagaucgcuaagcggccuaagguucgcgaucaggaaggaagaauuaauuacuauuggacgcuucuggagcccggcgacacaaucauuuuugaggccaacgggaaucucaucgcgccucgguacgccuucgcucugucccgcggauuuggcagcggcauuaucaacucuaaugcccccauggauaaaugugacgcuaagugccagaccccgcaaggggccaucaacuccagccuuccuuuccagaaugugcaucccgugacaauuggagaauguccuaaauaugucagaucugcgaagcugcggauggugaccggccuccgcaacauccccagcauucaguccagagggcuguuuggagccaucgcuggcuucauugaagggggauggaccggcaugguugauggcugguacggguaucaccaccagaaugaacaaggaucuggcuacgccgcugaccagaaaagcacacagaacgccaucaaugggaucacgaacaaggucaauuccgugauugagaaaaugaacacccaguuuacagccgugggaaaggaguucaacaagcuggagcggcgcauggagaaucucaacaaaaagguugaugacggcuucaucgauauuuggaccuacaaugcugaacugcuugugcugcucgagaacgaaagaacacuggacuuucaugacagcaaugucaaaaaccuuuaugagaaggugaaaucucaacugaagaauaacgcgaaggaaaucgggaauggcugcuucgaguuuuaccacaaauguaacgaugagugcauggaauccgucaagaauggaaccuaugacuaccccaaauauagcgaggaaucuaagcucaaccgggagaaaauugauggcgugaagcuggaguccauggggguuuaccagauccuggccaucuauagcacgguggcuuccucucucguccugcuugugagccugggagccauuuccuucuggaugugcucuaauggcagccuccagugucgcaucugcauuuga

SEQ ID NO: 185669 - RNA, 1701 nt, Artificial Sequence
  derived and/or modified sequence opt5 from hemagglutinin__InfluenzaA__ACO95426
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucgacuggaccggcgugacacagaacggcaccuccagcucuugcaagcgcagauccaauaacagcuuuuucucucggcugaauuggcucacacaucugaaguauaaauacccugcucuuaacgucaccaugcccaauaacgagaaguuugauaaacuguauaucuggggagugcaccauccugggacggacuccgaucagauuagccucuacgcccaggcguccggccgcaucacaguuucuaccaagagaagccaacagacagugauuccgaacaucgggucccggccccgcgucagagacgugagcucucggauuuccaucuacuggaccaucgugaaaccuggagacauucugcugaucaauagcaccggcaaccucauugcccccagaggguauuucaagaucagaucuggaaagagcuccauuaugcggucugaugcuccuaucggcaaauguaauagcgagugcaucacacccaacggcuccauuccgaaugacaagccuuuucagaacgucaaucgcaucacguacggggccugucccagauauguuaaacagaacacccugaaacuugcuacaggaaugcggaaugugccugaaaaacaaacccgcggcauuuucggggccaucgcgggauuuauugagaacggcugggaagggaugguggauggaugguacggcuucagacaccagaauagcgagggcacagggcaggccgcugaccugaagucuacccaagccgcuaucaaccagaucaauggaaaacucaaccggcugauuggcaagacgaaugagaaguuucaccagaucgaaaaagaguucuccgaagucgaggggcgcauucaggaucuugaaaaguauguggaggacacaaaaaucgaucuguggagcuacaacgccgagcuccugguugcccuggaaaaccaacauaccauugaccucaccgauucugagaugaauaagcuguucgaacgcacaaagaagcagcuucgggagaacgcugaagacaugggaaauggcugcuuuaagaucuaucacaaaugugauaacgcgugcauuggguccaucagaaauggcaccuacgaccaugacguguaccgcgaugaggcccugaacaaucgguuccagaucaagggagucgagcucaaaagcggcuauaaggacuggauucuguggaucuccuuugcuauuucuugcuuccuucuguguguggcccuccugggguuuaucaugugggccugccagaaaggaaacauuagauguaauaucugcaucuga

SEQ ID NO: 185670 - RNA, 1701 nt, Artificial Sequence; identical to SEQ ID NO: 184819
  derived and/or modified sequence opt5 from hemagglutinin__InfluenzaA__ACO95437

SEQ ID NO: 185671 - RNA, 1701 nt, Artificial Sequence
  derived and/or modified sequence opt5 from hemagglutinin__InfluenzaA__ACO95448
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaucuuucaacuggaccggcguuacacagaauggcaccuccagcgcuugcaagcgcagaucuaacaauuccuuuuucagccggcugaacuggcucacacaucugaaguuuaaauauccugcccuuaaugugaccaugcccaacaacgaggaguucgacaagcuguacauuuggggaguccaccauccugggacggauaaugaccagaucaaccucuaugcgcaggccucuggccgcauuacaguguccaccaaaagaagccaacagacaguuaucccgaauauugggucccggccccgcgugagagauaucccuucucggaucagcauuuacuggaccaucgucaagcccggagacauucugcugaucaacuccaccggcaaucucauugcuccucgcggguacuuuaaaaucagaagcggaaagucuuccaucaugcggagcgacgcccccauuggcaaguguaacucugaaugcaucacaccgaauggcagcauuccuaacgauaaacccuuccagaaugugaaccgcaucacguauggggcuuguccuagauacgugaagcagaauacccugaaacuugccacaggaaugcggaacguccccgagaagcaaacccgcggcauuuuuggggcgaucgccggauucaucgaaaauggcugggaggggaugguugacggaugguauggcuuuagacaccagaacuccgagggcauugggcaggcugccgaucugaaaucuacacaagcugccaucgaccagauuaauggaaagcucaaccggcugaucggcaaaaccaacgaaaaguuccaccagauugagaaggaguucagcgaaguggaagggagaauccaggaucuugagaaauacguggaggacacgaagauugaucugugguccuauaaugccgaacuccuggucgcucuggagaaccaacauacaaucgaccucaccgauagcgaaaugaauaaacuguuugagcgcaccaagaaacagcuucgggaaaacgcggaggacaugggaaauggcugcuucaagaucuaccacaagugugauaacgccugcauugggucuaucagaaauggcacauaugaccaugacguguaccgcgaugaggcucugaacaaucgguuucagauuaaaggaguugaacucaaguccggcuacaaagacuggauccuguggauuagcuucgccaucucuugcuuucuucuguguguggcccuccugggguucaucaugugggcuugccagaagggaaacauuagauguaauaucugcauuuga

SEQ ID NO: 185672 - RNA, 1701 nt, Artificial Sequence; identical to SEQ ID NO: 183654
  derived and/or modified sequence opt5 from hemagglutinin__InfluenzaA__ACO95459

SEQ ID NO: 185673 - RNA, 1701 nt, Artificial Sequence
  derived and/or modified sequence opt5 from hemagglutinin__InfluenzaA__ACO95470
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggccgcuguaacucugagugcauuacaccgaauggcagcaucccuaacgacaaacccuuucagaaugugaacagaauuacguauggggcuuguccucgguacgucaagcagaauacccugaaacuugccacaggaaugcgcaacguucccgaaaagcaaaccagaggcaucuucggggcgauugccggauuuaucgagaauggcugggaagggaugguggauggaugguauggcuuccggcaccagaacuccgagggcaucgggcaggcugccgaccugaaaucuacacaagcugccauuaaucagaucaacggaaagcucaacagacugauuggcaaaaccaaugagaaguuccaccagaucgaaaaggaguuuagcgaaguggaggggcgcauucaggaucuugaaaaauacgucgaggacacgaagaucgaucugugguccuauaacgccgagcuccugguggcucuggaaaaucaacauacaauugaccucaccgauagcgagaugaacaaacuguucgaacggaccaagaaacagcuuagagagaaugcggaagacaugggaaacggcugcuuuaagaucuaccacaagugugauaaugccugcaucgggucuauucgcaacggcacauaugaccaugauguuuaccgggacgaggcucugaauaacagauuccagaucaaaggaguggagcucaaguccggcuacaaagacuggauucuguggaucagcuuugccauuucuugcuuccuucugugugucgcccuccugggguuuaucaugugggcuugccagaagggaaauauccgcuguaacauuugcaucuga

SEQ ID NO: 185674 - RNA, 1701 nt, Artificial Sequence
  derived and/or modified sequence opt5 from hemagglutinin__InfluenzaA__ACO95481
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaacccggagauauccugcugauuaacuccaccggcaaucucaucgcuccucgcggguacuucaagauuagaagcggaaagucuuccaucaugcggagcgacgcccccaucggcaaauguaacucugagugcauuacaccgaauggcagcaucccuaacgacaagcccuuucagaaugugaaccgcauuacguauggggcuuguccuagauacgucaaacagaauacccugaaacuugccacaggaaugcggaaccugcccgaaaagcaaacccgcggcaucuucggggcgauugccggauuuaucgagaauggcugggaagggaugguugauggaugguauggcuucagacaccagaacuccgagggcaucgggcaggcugccgaccucaagucuacacaagcugccauuaaucagaucaacggaaaacugaaccggcuuauuggcaagaccaaugagaaguuccaccagaucgaaaaagaguuuagcgaaguggaggggcgcauucaggaucuggaaaaguacguggaggacacgaaaaucgaucucugguccuauaacgccgagcugcuggucgcucucgaaaaucaacauacaauugaccugaccgauagcgagaugaacaaacuuuucgaaagaaccaagaagcagcugcgggagaaugcggaagacaugggaaacggcugcuuuaagaucuaccacaaaugugauaaugccugcaucgggucuauuagaaacggcacauaugaccaugauguguaccgcgacgaggcucucaauaaccgguuccagaucaagggaguugagcugaaauccggcuacaaggacuggauucuuuggaucagcuuugccauuucuugcuuccugcucuguguggcccugcugggguuuaucaugugggcuugccagaaaggaaauaucagauguaacauuugcaucuga

SEQ ID NO: 185675 - RNA, 1701 nt, Artificial Sequence; identical to SEQ ID NO: 183654
  derived and/or modified sequence opt5 from hemagglutinin__InfluenzaA__ACO95492

SEQ ID NO: 185676 - RNA, 1701 nt, Artificial Sequence; identical to SEQ ID NO: 183654
  derived and/or modified sequence opt5 from hemagglutinin__InfluenzaA__ACO95503

SEQ ID NO: 185677 - RNA, 1701 nt, Artificial Sequence; identical to SEQ ID NO: 183654
  derived and/or modified sequence opt5 from hemagglutinin__InfluenzaA__ACO95514

SEQ ID NO: 185678 - RNA, 1701 nt, Artificial Sequence; identical to SEQ ID NO: 183654
  derived and/or modified sequence opt5 from hemagglutinin__InfluenzaA__ACO95536

SEQ ID NO: 185679 - RNA, 1701 nt, Artificial Sequence; identical to SEQ ID NO: 183654
  derived and/or modified sequence opt5 from hemagglutinin__InfluenzaA__ACO95547

SEQ ID NO: 185680 - RNA, 1701 nt, Artificial Sequence
  derived and/or modified sequence opt5 from hemagglutinin__InfluenzaA__ACP41963
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaaacuugaauccacccggaucuaucaaauucuggccaucuacagcacaguggcguccucucucguccuggugguuagccugggcgcuauuuccuuuuggaugugcucuaacggaagccuccagugccgcaucuguauuuga

SEQ ID NO: 185681 - RNA, 1698 nt, Artificial Sequence; identical to SEQ ID NO: 185667
  derived and/or modified sequence opt5 from hemagglutinin__InfluenzaA__ACP44192

SEQ ID NO: 185682 - RNA, 1698 nt, Artificial Sequence; identical to SEQ ID NO: 185667
  derived and/or modified sequence opt5 from hemagglutinin__InfluenzaA__ACP44203

SEQ ID NO: 185683 - RNA, 1698 nt, Artificial Sequence
  derived and/or modified sequence opt5 from hemagglutinin__InfluenzaA__ACP44225
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcggccugcuuaucuccaaagaaucuuggagcuacauuguggagaagccgaaccccgaaaaugggaccuguuauccuggacauuuugccgauuacgaggagcugagagaacaacucuccucugucagcuccuucgagcgguuugaaaucuuccccaaggagagcucuuggccuaaccacacggugaccggcguuuccgccagcugcucucauaauggcgaguccagcuuuuaucgcaaccugcuuuggcugacagggaaaaauggacucuaccccaaccugucuaaguccuaugcuaauaacaaagaaaaggaggugcugguccucuggggcgugcaccacccuccgaacaucggggaccagaaagcccuguaccauaccgaaaaugcuuacgugagcgucguuuccucucacuauagcagaaaguucacacccgagauugccaagcggccuaaagugcgcgaucaggaaggaagaaucaacuacuauuggacccuucuggagcccggcgacacgauuaucuuugaggcgaaugggaaccucauugccccucgguacgcuuucgcccugucccgcggauuuggcagcggcaucauuaauucuaacgcucccauggauaagugugacgccaaaugccagacaccgcaaggggcgaucaauuccagccuuccuuuccagaacgugcaucccgucaccaucggagaauguccuaaguaugugagaucugccaaacugcggaugguuacaggccuccgcaauauucccagcauccaguccagagggcuguuuggagcuauugccggcuucaucgaagggggauggaccggcaugguggauggcugguacggguaucaccaccagaacgaacaaggaucuggcuacgcugccgaccaaaagagcacccagaaugccauuaacgggaucacaaauaaagucaacuccgugaucgagaagaugaauacgcaguuuaccgcuguuggaaaggaguucaacaaacuggagcggcgcauggagaaccucaauaagaaaguggaugacggcuucauugauaucuggacauacaacgcggaacugcuuguccugcucgagaaugaaagaacccuggacuuucaugacagcaacgugaagaaucuuuaugagaaagucaagucucagcugaagaacaaugccaaagaaauugggaacggcugcuucgaguuuuaccacaaguguaaugaugagugcauggaauccgugaaaaacggaacauaugacuaccccaaguauagcaaagagucuaagcucaaucgggaaaagaucgauggcguuaaacuggaguccauggggguguaccagauucuggcuaucuauagcaccgucgccuccucucucgugcugcuuguuagccugggagccaucuccuucuggaugugcucuaacggcagccuccagugucgcauuugcaucuga

SEQ ID NO: 185684 - RNA, 1701 nt, Artificial Sequence
  derived and/or modified sequence opt5 from hemagglutinin__InfluenzaA__ACP44236
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucugacaaguccuuuuucagccggcugaacuggcucacacaucugaaauuuaaguauccugcccuuaaugucaccaugcccaacaaugagaaauucgauaagcuguacaucuggggagugcaccauccugggacggacaacgaucagauuucucucuaugcgcaggccuccggccgcaucacaguuagcaccaaaagaucccaacagacagugauuccgaacaucgggucucggccccgcgucagagacgugccuagccggauuuccaucuacuggaccaucgugaagcccggagacauucugcugaucaauagcaccggcaaccucauugcuccucgcggguacuuuaagaucagaucuggaaaauccagcauuaugcggucugaugcccccaucggcaaguguaauagcgagugcaucacaccgaacggcuccauuccuaaugacaaacccuuccagaacgucaaucgcaucacguauggggcuuguccuagauacguuaagcagaacacccugaaacuugccacaggaaugcggaaugugcccgaaaagcaaacccgcggcauuuuuggggcgaucgccggauucauugagaacggcugggaagggaugguggauggaugguauggcuuuagacaccaaaauucugagggcacagggcaggcugccgaccugaaaagcacccaggcugccaucaaccagaucaauggaaagcucaaccggcugauuggcaagacgaaugagaaauuccaccagaucgaaaaggaguucuccgaagucgaggggcgcauucaggaucuugaaaaauacguggaggacacaaagaucgaucuguggagcuauaacgccgagcuccugguugcucuggaaaaccaacauaccauugaccucaccgauucugagaugaauaaacuguuugaaagaacaaagaagcagcuucgggagaacgcggaagacaugggaaauggcugcuucaaaaucuaccacaagugugauaacgccugcauuggguccaucagaaauggcaccuaugaccaugacguguaccgcgaugaggcucugaacaaucgguuucagaucaaaggagucgagcucaagagcggcuacaaagacuggauucuguggaucucuuucgccauuuccugcuuucuucuguguguggcccuccugggguucaucaugugggcuugccagaagggaaacauuagauguaauaucugcaucuga

SEQ ID NO: 185685 - RNA, 1701 nt, Artificial Sequence; identical to SEQ ID NO: 185621
  derived and/or modified sequence opt5 from hemagglutinin__InfluenzaA__ACP44247

SEQ ID NO: 185686 - RNA, 1701 nt, Artificial Sequence; identical to SEQ ID NO: 183654
  derived and/or modified sequence opt5 from hemagglutinin__InfluenzaA__ACP44258

SEQ ID NO: 185687 - RNA, 1701 nt, Artificial Sequence; identical to SEQ ID NO: 183654
  derived and/or modified sequence opt5 from hemagglutinin__InfluenzaA__ACP44269

SEQ ID NO: 185688 - RNA, 1701 nt, Artificial Sequence; identical to SEQ ID NO: 185680
  derived and/or modified sequence opt5 from hemagglutinin__InfluenzaA__ACQ44554

SEQ ID NO: 185689 - RNA, 1701 nt, Artificial Sequence; identical to SEQ ID NO: 185680
  derived and/or modified sequence opt5 from hemagglutinin__InfluenzaA__ACQ44556

SEQ ID NO: 185690 - RNA, 1701 nt, Artificial Sequence; identical to SEQ ID NO: 185680
  derived and/or modified sequence opt5 from hemagglutinin__InfluenzaA__ACQ45338

SEQ ID NO: 185691 - RNA, 1701 nt, Artificial Sequence
  derived and/or modified sequence opt5 from hemagglutinin__InfluenzaA__ACQ55359
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcagcuccagauauagcaagaaauuuaagccggagauugcuauccggcccaaaguccgcgaucaggaggggagaaugaauuacuauuggacacugguugaaccuggagacaagauuaccuucgaggccacgggcaaccugguggugccccgguacgcguuugccauggaacgcaacgcugggucuggaaucauuaucuccgauacaccuguccaugacugcaauaccacaugucaaacccccaaaggcgccaucaacaccagccucccguuccagaauauucacccuaucacaauuggcaagugccccaaguaugugaaaucuacgaagcugagacuugcuaccgggcugcggaacaucccuagcauucagucccgcggacucuuuggcgccaucgccggguucaucgagggaggcuggacagggaugguugacggaugguacggcuaucaucaccagaaugaacaaggcucuggguacgcugcggaucugaaaagcacccagaacgccauugacgagaucacaaauaaggugaacuccgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauaccuguauggaauccgucaaaaacggcacauacgauuaucccaaguacagcgaggaagcuaaacugaauagagaggagaucgacggggugaaacuugaaucuacccggauuuaucaaauccuggccauuuacuccacaguugcgagcucccucgugcuggucgugucucugggcgcuaucagcuuuuggaugugcuccaacggaucucuccagugccgcauuuguaucuga

SEQ ID NO: 185692 - RNA, 1701 nt, Artificial Sequence; identical to SEQ ID NO: 185680
  derived and/or modified sequence opt5 from hemagglutinin__InfluenzaA__ACQ55361

SEQ ID NO: 185693 - RNA, 1701 nt, Artificial Sequence
  derived and/or modified sequence opt5 from hemagglutinin__InfluenzaA__ACQ63223
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 185694 - RNA, 1701 nt, Artificial Sequence; identical to SEQ ID NO: 185693
  derived and/or modified sequence opt5 from hemagglutinin__InfluenzaA__ACQ63239

SEQ ID NO: 185695 - RNA, 1701 nt, Artificial Sequence; identical to SEQ ID NO: 185693
  derived and/or modified sequence opt5 from hemagglutinin__InfluenzaA__ACQ63244

SEQ ID NO: 185696 - RNA, 1701 nt, Artificial Sequence; identical to SEQ ID NO: 185693
  derived and/or modified sequence opt5 from hemagglutinin__InfluenzaA__ACQ63257

SEQ ID NO: 185697 - RNA, 1701 nt, Artificial Sequence
  derived and/or modified sequence opt5 from hemagglutinin__InfluenzaA__ACQ65691
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcucuugcaagcgcggguccgacaacagcuuuuucucuagacugaauuggcucacacaucugaaguuuaaauauccugcucuuaacgucaccaugcccaauaacgagaaguucgauaaacuguacaucuggggagugcaccauccuggcacggacaacgaucagauuuuuccguaugcccaggcguccgggcggaucacaguuagcaccaagcgcucccaacagacagugauucccaauaucggaucuagaccucggguccgcgacauucccagcagaaucuccaucuacuggaccauugugaaaccuggcgacauccuccugauuaacagcaccgggaaucugaucgcuccccggggauacuucaagauucgcucuggcaaguccagcaucaugagaucugaugccccgaucggcaaauguaacagcgagugcauuacaccuaauggguccauccccaacgacaagccuuuucagaaugugaaccggauuacguauggagccuguccccgcuacgucaaacagaauacccucaagcuggcuacaggcaugagaaacguucccgaaaaacaaacccgggggaucuucggagccauugcgggcuuuaucgagaaugggugggaaggaaugguggauggcugguauggcuuccgccaccagaacucugaggggaucggacaggccgcugaccuuaagagcacacaagccgcuauuaaucagaucaacggcaaacugaauagacucauugggaagaccaacgagaaguuccaccagaucgaaaaagaguuuuccgaaguggagggacggauucaggaucuggaaaaguacgucgaggacacgaaaaucgaucuuuggagcuauaacgccgagcugcucguggcccuggaaaaucaacauacaauugaccugaccgauucugagaugaacaaacucuucgaaagaaccaagaagcagcugcgcgagaaugcugaagacaugggcaacgggugcuuuaagaucuaccacaaaugugauaaugcgugcaucggcuccauucggaacggaacauaugaccaugacguuuacagagaugaggcccuuaauaaccgcuuccagaucaagggcguggagcugaaaagcggguacaaggacuggauucucuggaucucuuuuaccauuuccugcuuccugcuuugugucgcucugcucggauuuaucaugugggccugccagaaaggcaauauccgguguaacauuugcaucuga

SEQ ID NO: 185698 - RNA, 1701 nt, Artificial Sequence; identical to SEQ ID NO: 185458
  derived and/or modified sequence opt5 from hemagglutinin__InfluenzaA__ACQ65713

SEQ ID NO: 185699 - RNA, 1701 nt, Artificial Sequence
  derived and/or modified sequence opt5 from hemagglutinin__InfluenzaA__ACQ65724
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacugggcuggagugacccagaauggcacauccagcgccugcauccgcagaucuaacaauuccuuuuucagccggcugaacuggcucacccaucugaaguuuaaguauccugcgcuuaaugucacaaugcccaacaacgagcaguucgacaaacuguacauuuggggcgugcaccauccugggaccgauaaugaccagaucuuucucuaugcccaggcuucuggacgcauuacgguuuccacaaagagaagccaacagaccgugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaaaauacgcugaaacuugcgaccgggaugcggaacguucccgagaagcagacacgcggaauuuucggcgccaucgcuggguuuaucgaaaauggaugggagggcaugguggaugggugguauggauucagacaccagaacuccgagggccggggccaagccgcugaccugaagucuacccaggccgccauugaucagaucaaugggaaacucaacagacugauuggaaagacaaacgaaaaauuccaccagaucgagaaggaauuuagcgagguggaaggccgcauucaagaccuugagaaguacgucgaggauaccaaaaucgaccugugguccuauaaugcugaacuccugguggcgcuggagaaccagcauacgauugaucucacagacagcgaaaugaauaagcuguucgagaaaaccaagaaacagcuucgggaaaacgccgaggauauggggaauggaugcuuuaagaucuaccacaagugugacaacgcuugcaucggcucuauuagaaaugggaccuaugaucaugacguuuaccgcgacgaggcccugaacaaucgguuccagaucaaaggcguggaacucaaguccggauacaaagauuggauucuguggaucagcuuugccauuucuugcuuccuucugugugucgcucuccugggcuuuaucaugugggccugccaaaaggggaacaucagauguaauauuugcaucuga

SEQ ID NO: 185700 - RNA, 1701 nt, Artificial Sequence
  derived and/or modified sequence opt5 from hemagglutinin__InfluenzaA__ACQ65747
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaacaaacaauuccuuuuucucucggcugaacuggcucacccaucugaaguuuaaguauccugcccuuaaugucacgaugcccaacaacgagaaauucgacaagcuguacauuuggggcgugcaccauccugggacagauaaugaccagaucuuucucuaugcgcaggccagcggacgcauuaccguuucuacaaaaagaucccaacagaccgugaucccgaacauuggcagccggccccgcgucagaaauaucccuucccggaucucuauuuacuggaccaucgugaagcccggggauauucugcugaucaacagcacaggaaaucucauugcuccucgcggcuacuucaaaaucagauccgggaaaagcucuaucaugcgguccgacgcccccauuggaaaguguaacagcgaaugcaucacgccgaauggcucuauuccuaacgacaaacccuuucagaaugugaaccgcaucaccuauggcgcuuguccuagauacgucaagcagaauacacugaaacuugccaccgggaugcggaacguucccgagaagcaaacacgcggaauuuucggcgcgaucgccggguuuaucgaaaauggaugggagggcaugauggaugggugguauggauucagacaccagaacagcgagggcauuggccaggcugccgaccugaaauccacccaagcugccaucgaucagauuaaugggaagcucaacggacugaucggcaaaacgaacgaaaaguuccaccagauugagaaggaauuuucugagguggaagggcggauccaggaccuugagaaauacguggaggauacaaagauugaccuguggagcuauaaugccgaacuccuggucgcucuggagaaccaacauaccaucgaucucaccgacuccgaaaugaauaaacuguucgagaagacaaagaagcagcuuagagaaaacgcggaggauaugggaaauggcugcuuuaagaucuaccacaaaugugacaacgccugcauugggagcauccgcaauggcaccuaugaucaugacguguaccgggacgaggcucugaacaauagauuccagauuaagggaguugaacucaaaucuggcuacaaggauuggauccuguggauuuccuuugccaucagcugcuuccuucuguguguggcccuccugggguuuaucaugugggcuugccagaaaggaaacauucgcuguaauaucugcauuuga

SEQ ID NO: 185701 - RNA, 1698 nt, Artificial Sequence
  derived and/or modified sequence opt5 from hemagglutinin__InfluenzaA__ACQ65758
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacguggucgaaaagccgaaccccgagaauggcaccuguuauccugggcauuuugccgauuacgaggaacugagagagcaacucuccucugugagcuccuucgaacgguuugagauuuuccccaaggagagcucuuggccuaaccacacgguuaccggaguguccgccagcugcucucauaauggcgaauccagcuuuuaucgcaaccugcuuuggcugacaggcaaaaaugggcucuaccccaaccugucuaaguccuaugcuaauaacaaaggaaaggagguccuggugcucuggggcgugcaccacccuccgaacaucggggaccagaauacccuguaccauacagaaaacgccuacgucagcguuguguccucucacuauagcagaaaauucacccccgagaucgcuaagcggccuaaggugcgcgaucaggaaggaagaauuaauuacuauuggacgcuucuggagcccggcgacacaaucauuuuugaggccaacgggaaucucaucgcgccucgguacgccuucgcucugucccgcggauuuggcagcggcauuaucaacucuaaugcccccauggauaaaugugacgcuaagugccagaccccgcaaggggccauuaacuccagccuuccuuuccagaauguccaucccgugacaaucggagaauguccuaaauauguuagaucugcgaagcugcggauggugaccggccuccgcaacauccccagcauucaguccagagggcuguuuggagccaucgcuggcuucauugaagggggauggaccggcauggucgauggcugguacggguaucaccaccagaaugaacaaggaucuggcuacgccgcugaccagaaaagcacacagaacgccaucaaugggauuacgaacaagguuaauuccgugaucgagaaaaugaacacccaguuuacagccgugggaaaggaguucaacaagcuggagcggcgcauggagaaucucaacaaaaaggucgaugacggcuucaucgauauuuggaccuacaaugcugaacugcuugugcugcucgagaacgaaagaacacuggacuuucaugacagcaaugucaaaaaccuuuaugagaaggugaaaucucaacugaagaauaacgcgaaggaaaucgggaauggcugcuucgaguuuuaccacaaauguaacgaugagugcauggaauccguuaagaauggaaccuaugacuaccccaaauauagcgaggaaucuaagcucaaccgggagaaaauugauggcgugaagcuggaguccaugggggucuaccagauccuggccauuuauagcacgguggcuuccucucucguucugcuugugagccugggagccaucuccuucuggaugugcucuaauggcagccuccagugucgcaucugcauuuga

SEQ ID NO: 185702 - RNA, 1701 nt, Artificial Sequence; identical to SEQ ID NO: 185680
  derived and/or modified sequence opt5 from hemagglutinin__InfluenzaA__ACQ73386

SEQ ID NO: 185703 - RNA, 1701 nt, Artificial Sequence; identical to SEQ ID NO: 185693
  derived and/or modified sequence opt5 from hemagglutinin__InfluenzaA__ACQ73387

SEQ ID NO: 185704 - RNA, 1701 nt, Artificial Sequence
  derived and/or modified sequence opt5 from hemagglutinin__InfluenzaA__ACQ73555
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaagcccaacaacgagaaauucgacaagcuguacaucuggggagugcaccauccugggacggauaaugaccagauuuuucucuaugcgcaggccucuggccgcaucacaguuuccaccaaaagaagccaacagacagugauuccgaacaucgggucccggccccgcgucagaaauauuccuucucggaucagcaucuacuggaccauugugaagcccggagauauccugcugauuaacuccaccggcaaucucaucgcuccucgcggguacuucaagauuagaagcggaaaaucuuccaucaugcggagcgacgcccccaucggcaaguguaacucugagugcauuacaccgaauggcagcaucccuaacgacaaacccuuucagaaugugaaccgcauuacguauggggcuuguccuagauacgucaagcagaauacccugaaacuugccacaggaaugcggaacguucccgaaaagcaaacccgcggcaucuucggggcgauugccggauuuaucgagaauggcugggaagggaugguggauggaugguauggcuucagacaccagaacuccgagggcaucgggcaggcugccgaccugaaaucuacacaagcugccauuaaucagaucaacggaaagcucaaccggcugauuggcaagaccaaugagaaauuccaccagaucgaaaaggaguuuagcgaaguggaggggcgcauucaggaucuugaaaaauacgucgaggacacgaagaucgaucugugguccuauaacgccgagcuccugguggcucuggaaaaucaacauacaauugaccucaccgauagcgagaugaacaaacuguucgaaagaaccaagaagcagcuucgggagaaugcggaagacaugggaaacggcugcuuuaaaaucuaccacaagugugauaaugccugcaucgggucuauuagaaacggcacauaugaccaugauguuuaccgcgacgaggcucugaauaaccgguuccagaucaaaggaguggagcucaaguccggcuacaaagacuggauucuguggaucagcuuugccauuucuugcuuccuucugugugucgcccuccugggguuuaucaugugggcuugccagaagggaaauaucagauguaacauuugcaucuga

SEQ ID NO: 185705 - RNA, 1701 nt, Artificial Sequence; identical to SEQ ID NO: 185693
  derived and/or modified sequence opt5 from hemagglutinin__InfluenzaA__ACQ76294

SEQ ID NO: 185706 - RNA, 1701 nt, Artificial Sequence; identical to SEQ ID NO: 185693
  derived and/or modified sequence opt5 from hemagglutinin__InfluenzaA__ACQ76314

SEQ ID NO: 185707 - RNA, 1701 nt, Artificial Sequence; identical to SEQ ID NO: 185693
  derived and/or modified sequence opt5 from hemagglutinin__InfluenzaA__ACQ76317

SEQ ID NO: 185708 - RNA, 1701 nt, Artificial Sequence
  derived and/or modified sequence opt5 from hemagglutinin__InfluenzaA__ACQ76318
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacacauacguguucgugggcagcuccagauauagcaagaaauuuaagccggagauugccauccggcccaaaguccgcgaucaggaggggagaaugaauuacuauuggacccugguugaaccuggagacaagauuacguucgaggcuacaggcaaccugguggugccccgguacgccuuugcgauggaacgcaacgccgggucuggaaucauuaucuccgauaccccuguccaugacugcaauacaaccugucaaacccccaaaggcgcuaucaacacaagccucccguuccagaauauucacccuaucacgauuggcaagugccccaaguaugugaaaucuaccaagcugagacuugccacagggcugcggaacaucccuagcauucagucccgcggacucuuuggcgcuaucgccggguucaucgagggaggcuggaccgggaugguugacggaugguacggcuaucaucaccagaaugaacaaggcucuggguacgccgcugaucugaaaagcacacagaacgcgauugacgagaucaccaauaaggugaacuccgucauugagaaaaugaauacgcaguuuacagccgugggaaaggaguucaaccaccuugagaagagaaucgaaaaucugaacaaaaagguugaugacggcuuccucgauauuuggaccuacaaugcugagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuaucccaaguacagcgaggaagccaaacugaauagagaggagaucgacggggugaaacuugaaucuacacggauuuaucaaauccuggcuauuuacuccacgguugccagcucccucgugcuggucgugucucugggcgcgaucagcuuuuggaugugcuccaacggaucucuccagugccgcauuuguaucuga

SEQ ID NO: 185709 - RNA, 1701 nt, Artificial Sequence; identical to SEQ ID NO: 185680
  derived and/or modified sequence opt5 from hemagglutinin__InfluenzaA__ACQ76326

SEQ ID NO: 185710 - RNA, 1701 nt, Artificial Sequence; identical to SEQ ID NO: 185680
  derived and/or modified sequence opt5 from hemagglutinin__InfluenzaA__ACQ76336

SEQ ID NO: 185711 - RNA, 1701 nt, Artificial Sequence; identical to SEQ ID NO: 185680
  derived and/or modified sequence opt5 from hemagglutinin__InfluenzaA__ACQ76347

SEQ ID NO: 185712 - RNA, 1701 nt, Artificial Sequence; identical to SEQ ID NO: 185693
  derived and/or modified sequence opt5 from hemagglutinin__InfluenzaA__ACQ76365

SEQ ID NO: 185713 - RNA, 1701 nt, Artificial Sequence; identical to SEQ ID NO: 185693
  derived and/or modified sequence opt5 from hemagglutinin__InfluenzaA__ACQ76370

SEQ ID NO: 185714 - RNA, 1701 nt, Artificial Sequence; identical to SEQ ID NO: 185680
  derived and/or modified sequence opt5 from hemagglutinin__InfluenzaA__ACQ76376

SEQ ID NO: 185715 - RNA, 1701 nt, Artificial Sequence
  derived and/or modified sequence opt5 from hemagglutinin__InfluenzaA__ACQ76383
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggaaucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggauccagcagauauucuaagaaauuuaagccugagaucgcuauucggccgaaagugcgcgaucaggaggggagaaugaauuacuauuggacacuggucgaacccggagacaagaucaccuucgaggccacgggcaaccugguugugccucgguacgcguuugccauggaacgcaacgcuggguccggaauuaucaucagcgauacacccgugcaugacugcaauaccacaugucaaaccccuaaaggcgccauuaacaccucucuccccuuccagaauauccacccgauuacaaucggcaagugcccuaaguaugucaaaagcacgaagcugagacuugcuaccgggcugcggaacgugcccuccauucagucucgcggacucuuuggcgccaucgccggguucaucgagggaggcuggacagggaugguugacggaugguacggcuaucaucaccagaaugaacaaggcagcggguacgcugcggaucugaaauccacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 185716 - RNA, 1701 nt, Artificial Sequence; identical to SEQ ID NO: 185693
  derived and/or modified sequence opt5 from hemagglutinin__InfluenzaA__ACQ76389

SEQ ID NO: 185717 - RNA, 1701 nt, Artificial Sequence; identical to SEQ ID NO: 185680
  derived and/or modified sequence opt5 from hemagglutinin__InfluenzaA__ACQ76401

SEQ ID NO: 185718 - RNA, 1701 nt, Artificial Sequence; identical to SEQ ID NO: 185693
  derived and/or modified sequence opt5 from hemagglutinin__InfluenzaA__ACQ76405

SEQ ID NO: 185719 - RNA, 1701 nt, Artificial Sequence
  derived and/or modified sequence opt5 from hemagglutinin__InfluenzaA__ACQ76408
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucugcccuuccagaauauucacccgaucacaauuggcaagugcccuaaguaugugaaaagcacgaagcucagacuggcuaccgggcuucggaacguucccuccauccagucucgcggacuguuuggcgccauugccggguucaucgagggaggcuggacagggaugguggacggaugguacggcuaucaucaccagaaugaacaaggcagcggguacgcugcggaucucaaauccacccagaacgccaucgacgagauuacaaauaaggucaacagcgugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggaucuaucaaauucuugccaucuacagcacaguggcguccucucugguccucgugguuagccugggcgcuauuuccuuuuggaugugcucuaacggaagccugcagugccgcaucuguauuuga

SEQ ID NO: 185720 - RNA, 1701 nt, Artificial Sequence
  derived and/or modified sequence opt5 from hemagglutinin__InfluenzaA__ACQ77601
augaagaccaucauugcccugagcuacauccucugccuggcuuucgcccagaaacuucccggcaacgacaauuccacagcgacgcugugucucgggcaccaugcugugccuaacggaacccuggucaagacaauuaccaaugaucaaaucgagguuacaaacgccaccgaacuugugcagucuagcuccacaggcagaauuugcgacucuccgcaccagauccuggauggggagaauuguacccucaucgacgcccugcugggagauccccauugcgacggcuuucagaacaaagaaugggaucucuucguggagcggagcaaggcuuauuccgacuguuacccuuaugauguccccgacuacgccucucugcgcagccuuguggcuuccagcgggacgcuggaauuuaauaacgagucuuucaauuggaccggaguugcccaaaacggcacauccagcgcgugcaaaagacggucuauuaaguccuuuuucagccgccucaauuggcugcaccagcuugagaacagauauccugcccccaaugugaccaugccuaacaaugauaaguuugacaaacuguacaucuggggcguccaucacccgucuacagauuccgaccagauuagcguguaugcucaggccuccgggcggguuaccgugucuacgaagcgcagccaacagacagucauccccaacauuggauccagaccuugggugcggggcaucagcucucgcauuuccaucuacuggaccaucgugaaacccggggacauucuccugaucaacagcacaggaaaucugauugcuccuagaggcuacuucaagauccggucugggaaaagcuccauuaugcgcucugaugcccccaucggaaaguguaacagcgaaugcaucaccccgaauggcuccauuccuaacgacaagcccuuucagaaugucaacagaaucaccuauggcgcguguccucgguacguuaaacagaauacacucaagcuggccacggggaugcgcaacgugcccgagaaacaaaccagaggaauuuucggcgcuaucgccggguuuauugaaaauggaugggagggcaugauggaugggugguauggauuccggcaccagaacagcgagggcacaggccaggcugccgaccuuaagucuacccaagccgcuaucaaucagaucaacgggaaacugaauaagcucauugagaaaacaaacgaaaaguuucaucagaucgaaaaggaguucuccgaaguggagggacgcauucaggaucuggagaaauacgucgaagacaccaagaucgaucuuuggagcuauaaugcggagcugcucguggcccuggaaaaccaacacacgauugaccugacagauucugagaugaacaaacucuucgaaagaacccggaagcagcugagagagaaugcugaggacaugggcaacgggugcuuuaaaaucuaccauaagugugauaaugccugcauuggauccauccgcaacggcaccuaugaccacgacguuuaccgggaugaagcccuuaauaacagauuccagaucaaggggguggagcugaaaagcggcuacaaggacuggauucucuggaucuccuuugcuauuucuugcuuccugcuuugugucgugcugcucggauuuaucaugugggccugccagaaaggcaauauucgcuguaacaucugcaucuga

SEQ ID NO: 185721 - RNA, 1701 nt, Artificial Sequence
  derived and/or modified sequence opt5 from hemagglutinin__InfluenzaA__ACQ83310
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcaugucuuccuucgaacgcuuugagaucuuccccaagaccagcucuuggccuaaucacgauuccaacaagggagucacagccgcuuguccccaugccggcgcgaaaucuuuuuauaagaaucugaucuggcucgugaaaaagggcaacagcuacccuaaacuguccaagagcuauauuaaugacaaggggaaagaaguucuugugcuguggggaauccaccaccccuccaccucugccgaucaacagagccucuaccagaacgcugacgccuacgucuucgugggcuccagcagauauucuaagaaacugaagccugagauugcuauccggccgaaagugcgcgaucaggaggggagaaugaauuacuauuggacacuggucgaacccggagacaagauuaccuuugaggccacgggcaaccucguugugccucgguacgcguucgccauggaacgcaacgcuggguccggaaucauuaucagcgauacacccgugcaugacugcaauaccacaugucaaaccccuaaaggcgccaucaacaccucucugcccuuucagaauauucacccgaucacaauuggcaagugcccuaaguaugucaaaagcacgaaacuuagacuggcuaccgggcuccggaacgugcccuccauccagucucgcggacuguucggcgccauugccggguuuaucgagggaggcuggacagggaugguugacggaugguacggcuaucaucaccagaaugaacaaggcagcggguacgcugcggaucuuaaguccacccagaacgccaucgacgagauuacaaauaaggugaacagcgucaucgagaaaaugaauacccaguucacggcugugggaaaggaauuuaaccaccuggagaagagaauugaaaaucucaacaaaaagguugaugacggcuuccuggauaucuggacauacaaugccgagcugcucgugcugcuugaaaacgagcggacccuggacuaucaugauucuaaugucaaaaaccucuacgagaaggugcgcucccagcugaaaaacaaugccaaggaaauugggaacggauguuucgaguuuuaucacaagugcgacaauaccuguauggaaagcgucaaaaacggcacauacgauuauccuaaguacucugaggaagcuaaacuuaauagagaggagaucgacggggugaagcuggaauccacccggaucuaucaaauucucgccaucuacagcacaguugcguccucucuggugcuggucgugagccucggcgcuauuuccuucuggaugugcucuaacggaagccugcagugccgcaucuguauuuga

SEQ ID NO: 185722 - RNA, 1701 nt, Artificial Sequence; identical to SEQ ID NO: 185680
  derived and/or modified sequence opt5 from hemagglutinin__InfluenzaA__ACQ84451

SEQ ID NO: 185723 - RNA, 1701 nt, Artificial Sequence; identical to SEQ ID NO: 185680
  derived and/or modified sequence opt5 from hemagglutinin__InfluenzaA__ACQ84457

SEQ ID NO: 185724 - RNA, 1701 nt, Artificial Sequence
  derived and/or modified sequence opt5 from hemagglutinin__InfluenzaA__ACQ84477
augaaggccauccugcucgugcugcuuuacaccuucacagcugccaacgcggacacgcugugcauuggcuaucacgcuaauaacagcaccgauacagucgacaccguucucgagaagaaugugacagugacccauuccgucaaccugcuugaagauagacacaaugggaagcuguguaaacuccggggaguggcuccccugcaucugggcaagugcaacaucgccggguggcuccugggaaauccugagugugaacuucuguuuacagccucuagcugguccuacauuguugagaccucuaacagcgacaauggcacgugcuauccgggggauuucaucaacuacgaagaacuccgcgagcagcuguccucugugagcuccuuugaaagauucgagauuuuucccaaagccagcucuuggccugaccacgaaaccaaucggggagucacagcugccugucccuaugcgggcgccaacuccuucuaccgcaaucuuaucuggcuggugaagaagggcaacagcuauccuaaacucucuaaguccuacguuaauaacaaagagaaggaggugcugguccugugggggauccaucaucccccuaccagcacagaucaacagucucucuaccagaacgcugacgccuauguguuugugggauccagcaaauacaauaagaaguucaaaccggaaauugcuaccagacccaagguccggggccaggccgggcgcaugaacuauuacuggacgcugguugagccuggagauacaaucaccuuugaagcgacaggcaaucuuguggugcccagauaugccuucgcuaugaaacggggguccggaucuggcauuaucauuagcgacaccccuguccacgauugcaacaccacaugucaaacgcccaagggcgccaucaauaccucccugccguuucagaacauucacccugugacaaucggggagugccccaaauacguuaagagcaccaaacuccgcauggcuacaggacugagaaauaucccuucuauucagucccggggccuuuucggggccaucgccggauuuauugaaggcggguggaccggaaugaucgacggcugguauggcuaccaccaucagaacgagcaagggagcggauacgcugcggaucagaagucuacgcagaaugccauugacggcaucacaaacaaggugaauagcgucaucgagaaaaugaacacccaguucaccgcuguggggaaggaguucaaucaccuggagaaacgcauugaaaaccucaauaagaaaguugacgauggauuucuggacguguggacauauaacgccgagcugcucguccugcuugaaaacgagagaacccuggauuaccacgacuccaaugugaagaaccucuaugagaagguccggucucaacugaaaaauaacgccaaggaaaucggcaauggguguuucgaguuuuaccauaaaugcgaugacacauguauggaaagcgugaagaacggcacguaugauuaccccaaauauuccgaggaaagcaaacuuaaucgcgaggagauugacggaguuaagcuggaaucuaccagaaucuaccagauucucgcuaucuacuccacaguggccagcucucugguccugcucgugucccugggcgcgaucagcuucuggaugugcuccaacgggucucuucagugccggauuuguaucuga

SEQ ID NO: 185725 - RNA, 1701 nt, Artificial Sequence
  derived and/or modified sequence opt5 from hemagglutinin__InfluenzaA__ACQ89900
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugguugagaaaaugaauacccaguuuacggcugugggaaaggaguucaaccaccuugagaagagaaucgaaaaucugaacaaaaaggucgaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcguuaaaaacggcacauacgauuauccuaaguacucugaggaagcuaaacugaauagagaggagauugacggggugaaacuugaauccacccggaucuaucaaauccuggccauuuacagcacagucgcguccucucucgugcugguugugagccugggcgcuaucuccuuuuggaugugcucuaacggaagccuccagugccgcauuuguaucuga

SEQ ID NO: 185726 - RNA, 1701 nt, Artificial Sequence; identical to SEQ ID NO: 185693
  derived and/or modified sequence opt5 from hemagglutinin__InfluenzaA__ACQ89902

SEQ ID NO: 185727 - RNA, 1701 nt, Artificial Sequence
  derived and/or modified sequence opt5 from hemagglutinin__InfluenzaA__ACQ89904
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaagggcacgugcuauccgggggauuuuauugacuacgaagaacugcgggagcagcuuuccagcgucucuuccuucgaacgcuuugagaucuuccccaagaccagcucuuggccuaaccacgauuccaauaaaggagugacagccgcuuguccccaugccggcgccaagagcuuuuauaaaaaccugaucuggcucguuaagaaaggcaauucuuacccuaagcuguccaagagcuauauuaacgacaaagggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaucugguggugccucgguacgcguuugccauggaacgcaacgcugggucuggaaucauuaucuccgauacccccguccaugacugcaacacaaccugucaaaccccuaagggcgccaucaauacaagccuccccuuccagaacauucacccgaucacgauuggcaagugcccuaaauaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaggaguucaaucaccuggagaaaagaauugaaaaccugaauaagaaaguggaugacggcuuccucgauaucuggaccuacaacgccgagcugcugguccuccuggaaaaugagcggacccuugacuaucaugauagcaacgugaagaaucuguacgagaaaguccgcucucagcucaagaacaacgccaaggaaauugggaauggauguuuugaguucuaucacaaaugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 185728 - RNA, 1701 nt, Artificial Sequence; identical to SEQ ID NO: 185725
  derived and/or modified sequence opt5 from hemagglutinin__InfluenzaA__ACQ89905

SEQ ID NO: 185729 - RNA, 1701 nt, Artificial Sequence; identical to SEQ ID NO: 185680
  derived and/or modified sequence opt5 from hemagglutinin__InfluenzaA__ACQ99607

SEQ ID NO: 185730 - RNA, 1701 nt, Artificial Sequence; identical to SEQ ID NO: 185680
  derived and/or modified sequence opt5 from hemagglutinin__InfluenzaA__ACQ99608

SEQ ID NO: 185731 - RNA, 1701 nt, Artificial Sequence; identical to SEQ ID NO: 185680
  derived and/or modified sequence opt5 from hemagglutinin__InfluenzaA__ACQ99609

SEQ ID NO: 185732 - RNA, 1701 nt, Artificial Sequence; identical to SEQ ID NO: 185680
  derived and/or modified sequence opt5 from hemagglutinin__InfluenzaA__ACQ99611

SEQ ID NO: 185733 - RNA, 1701 nt, Artificial Sequence
  derived and/or modified sequence opt5 from hemagglutinin__InfluenzaA__ACQ99614
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugauucuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 185734 - RNA, 1701 nt, Artificial Sequence; identical to SEQ ID NO: 185733
  derived and/or modified sequence opt5 from hemagglutinin__InfluenzaA__ACQ99616

SEQ ID NO: 185735 - RNA, 1701 nt, Artificial Sequence; identical to SEQ ID NO: 185680
  derived and/or modified sequence opt5 from hemagglutinin__InfluenzaA__ACQ99617

SEQ ID NO: 185736 - RNA, 1701 nt, Artificial Sequence; identical to SEQ ID NO: 185680
  derived and/or modified sequence opt5 from hemagglutinin__InfluenzaA__ACQ99618

SEQ ID NO: 185737 - RNA, 1701 nt, Artificial Sequence; identical to SEQ ID NO: 185680
  derived and/or modified sequence opt5 from hemagglutinin__InfluenzaA__ACQ99619

SEQ ID NO: 185738 - RNA, 1701 nt, Artificial Sequence; identical to SEQ ID NO: 185680
  derived and/or modified sequence opt5 from hemagglutinin__InfluenzaA__ACQ99620

SEQ ID NO: 185739 - RNA, 1701 nt, Artificial Sequence; identical to SEQ ID NO: 185733
  derived and/or modified sequence opt5 from hemagglutinin__InfluenzaA__ACQ99621

SEQ ID NO: 185740 - RNA, 1701 nt, Artificial Sequence; identical to SEQ ID NO: 185680
  derived and/or modified sequence opt5 from hemagglutinin__InfluenzaA__ACQ99622

SEQ ID NO: 185741 - RNA, 1701 nt, Artificial Sequence
  derived and/or modified sequence opt5 from hemagglutinin__InfluenzaA__ACR01014
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauggaaaaucugaacaaaaagguggaugacggcuuccucgauauuuggacauacaaugccgagcugcugguccuccuggaaaacgagcggacccuugacuaucaugauucuaaugugaaaaaccuguacgagaagguccgcucccagcucaaaaacaaugccaaggaaaucgggaacggauguuuugaguucuaucacaagugcgacaauaccuguauggaaagcgugaaaaacggcacauacgauuauccuaaguacucugaggaagcuaaacugaauagagaggagauugacgggguuaaacuugaauccacccggaucuaucaaauccuggccauuuacagcacaguggcguccucucucguccuggugguuagccugggcgcuaucuccuuuuggaugugcucuaacggaagccuccagugccgcauuuguaucuga

SEQ ID NO: 185742 - RNA, 1701 nt, Artificial Sequence; identical to SEQ ID NO: 185693
  derived and/or modified sequence opt5 from hemagglutinin__InfluenzaA__ACR08419

SEQ ID NO: 185743 - RNA, 1701 nt, Artificial Sequence
  derived and/or modified sequence opt5 from hemagglutinin__InfluenzaA__ACR08429
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacaccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 185744 - RNA, 1701 nt, Artificial Sequence; identical to SEQ ID NO: 185693
  derived and/or modified sequence opt5 from hemagglutinin__InfluenzaA__ACR08439

SEQ ID NO: 185745 - RNA, 1701 nt, Artificial Sequence; identical to SEQ ID NO: 185693
  derived and/or modified sequence opt5 from hemagglutinin__InfluenzaA__ACR08449

SEQ ID NO: 185746 - RNA, 1701 nt, Artificial Sequence
  derived and/or modified sequence opt5 from hemagglutinin__InfluenzaA__ACR08459
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcgacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggauggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacaccuguauggaaagcgugaaaaauggcacauacgacuauccuaaguacucugaggaagcuaaacugaacagagaggagaucgaugggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 185747 - RNA, 1701 nt, Artificial Sequence; identical to SEQ ID NO: 185680
  derived and/or modified sequence opt5 from hemagglutinin__InfluenzaA__ACR08528

SEQ ID NO: 185748 - RNA, 1701 nt, Artificial Sequence; identical to SEQ ID NO: 185680
  derived and/or modified sequence opt5 from hemagglutinin__InfluenzaA__ACR08530

SEQ ID NO: 185749 - RNA, 1701 nt, Artificial Sequence; identical to SEQ ID NO: 185746
  derived and/or modified sequence opt5 from hemagglutinin__InfluenzaA__ACR08531

SEQ ID NO: 185750 - RNA, 1701 nt, Artificial Sequence; identical to SEQ ID NO: 185693
  derived and/or modified sequence opt5 from hemagglutinin__InfluenzaA__ACR08533

SEQ ID NO: 185751 - RNA, 1701 nt, Artificial Sequence; identical to SEQ ID NO: 185746
  derived and/or modified sequence opt5 from hemagglutinin__InfluenzaA__ACR08535

SEQ ID NO: 185752 - RNA, 1701 nt, Artificial Sequence; identical to SEQ ID NO: 185693
  derived and/or modified sequence opt5 from hemagglutinin__InfluenzaA__ACR08536

SEQ ID NO: 185753 - RNA, 1701 nt, Artificial Sequence; identical to SEQ ID NO: 185746
  derived and/or modified sequence opt5 from hemagglutinin__InfluenzaA__ACR08537

SEQ ID NO: 185754 - RNA, 1701 nt, Artificial Sequence; identical to SEQ ID NO: 185746
  derived and/or modified sequence opt5 from hemagglutinin__InfluenzaA__ACR08538

SEQ ID NO: 185755 - RNA, 1701 nt, Artificial Sequence; identical to SEQ ID NO: 185693
  derived and/or modified sequence opt5 from hemagglutinin__InfluenzaA__ACR08539

SEQ ID NO: 185756 - RNA, 1701 nt, Artificial Sequence; identical to SEQ ID NO: 185693
  derived and/or modified sequence opt5 from hemagglutinin__InfluenzaA__ACR08540

SEQ ID NO: 185757 - RNA, 1701 nt, Artificial Sequence; identical to SEQ ID NO: 185680
  derived and/or modified sequence opt5 from hemagglutinin__InfluenzaA__ACR08542

SEQ ID NO: 185758 - RNA, 1701 nt, Artificial Sequence; identical to SEQ ID NO: 185680
  derived and/or modified sequence opt5 from hemagglutinin__InfluenzaA__ACR08543

SEQ ID NO: 185759 - RNA, 1701 nt, Artificial Sequence; identical to SEQ ID NO: 185719
  derived and/or modified sequence opt5 from hemagglutinin__InfluenzaA__ACR08544

SEQ ID NO: 185760 - RNA, 1701 nt, Artificial Sequence; identical to SEQ ID NO: 185746
  derived and/or modified sequence opt5 from hemagglutinin__InfluenzaA__ACR08545

SEQ ID NO: 185761 - RNA, 1701 nt, Artificial Sequence; identical to SEQ ID NO: 185680
  derived and/or modified sequence opt5 from hemagglutinin__InfluenzaA__ACR08546

SEQ ID NO: 185762 - RNA, 1701 nt, Artificial Sequence; identical to SEQ ID NO: 185693
  derived and/or modified sequence opt5 from hemagglutinin__InfluenzaA__ACR08547

SEQ ID NO: 185763 - RNA, 1701 nt, Artificial Sequence; identical to SEQ ID NO: 185746
  derived and/or modified sequence opt5 from hemagglutinin__InfluenzaA__ACR08548

SEQ ID NO: 185764 - RNA, 1701 nt, Artificial Sequence; identical to SEQ ID NO: 185693
  derived and/or modified sequence opt5 from hemagglutinin__InfluenzaA__ACR08549

SEQ ID NO: 185765 - RNA, 1701 nt, Artificial Sequence; identical to SEQ ID NO: 185693
  derived and/or modified sequence opt5 from hemagglutinin__InfluenzaA__ACR08550

SEQ ID NO: 185766 - RNA, 1701 nt, Artificial Sequence; identical to SEQ ID NO: 185693
  derived and/or modified sequence opt5 from hemagglutinin__InfluenzaA__ACR08551

SEQ ID NO: 185767 - RNA, 1701 nt, Artificial Sequence; identical to SEQ ID NO: 185680
  derived and/or modified sequence opt5 from hemagglutinin__InfluenzaA__ACR08552

SEQ ID NO: 185768 - RNA, 1701 nt, Artificial Sequence; identical to SEQ ID NO: 185719
  derived and/or modified sequence opt5 from hemagglutinin__InfluenzaA__ACR08553

SEQ ID NO: 185769 - RNA, 1701 nt, Artificial Sequence; identical to SEQ ID NO: 185719
  derived and/or modified sequence opt5 from hemagglutinin__InfluenzaA__ACR08554

SEQ ID NO: 185770 - RNA, 1701 nt, Artificial Sequence; identical to SEQ ID NO: 185680
  derived and/or modified sequence opt5 from hemagglutinin__InfluenzaA__ACR09365

SEQ ID NO: 185771 - RNA, 1701 nt, Artificial Sequence; identical to SEQ ID NO: 185680
  derived and/or modified sequence opt5 from hemagglutinin__InfluenzaA__ACR09366

SEQ ID NO: 185772 - RNA, 1701 nt, Artificial Sequence; identical to SEQ ID NO: 185680
  derived and/or modified sequence opt5 from hemagglutinin__InfluenzaA__ACR09367

SEQ ID NO: 185773 - RNA, 1701 nt, Artificial Sequence; identical to SEQ ID NO: 185680
  derived and/or modified sequence opt5 from hemagglutinin__InfluenzaA__ACR09368

SEQ ID NO: 185774 - RNA, 1701 nt, Artificial Sequence; identical to SEQ ID NO: 185680
  derived and/or modified sequence opt5 from hemagglutinin__InfluenzaA__ACR09369

SEQ ID NO: 185775 - RNA, 1701 nt, Artificial Sequence; identical to SEQ ID NO: 185680
  derived and/or modified sequence opt5 from hemagglutinin__InfluenzaA__ACR09370

SEQ ID NO: 185776 - RNA, 1701 nt, Artificial Sequence; identical to SEQ ID NO: 185680
  derived and/or modified sequence opt5 from hemagglutinin__InfluenzaA__ACR09371

SEQ ID NO: 185777 - RNA, 1701 nt, Artificial Sequence; identical to SEQ ID NO: 185680
  derived and/or modified sequence opt5 from hemagglutinin__InfluenzaA__ACR09373

SEQ ID NO: 185778 - RNA, 1701 nt, Artificial Sequence; identical to SEQ ID NO: 185680
  derived and/or modified sequence opt5 from hemagglutinin__InfluenzaA__ACR09374

SEQ ID NO: 185779 - RNA, 1701 nt, Artificial Sequence
  derived and/or modified sequence opt5 from hemagglutinin__InfluenzaA__ACR09375
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaaaagaacgcuggguccggaaucauuaucagcgauacacccguccaugacugcaauaccacaugucaaaccccuaagggcgccaucaacaccucucuccccuuccagaauauucacccgaucacaauuggcaagugcccuaaauaugugaaaagcacgaaacugcgccuugcuaccgggcugagaaacguucccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaacgcauugaaaaucugaacaagaaaguggaugacggcuuccucgauaucuggacauacaaugccgagcugcugguccuccuggaaaacgagagaacccuugacuaucaugauucuaaugugaagaaccuguacgagaaaguccggucccagcucaagaacaaugccaaggaaauugggaacggauguuuugaguucuaucacaaaugcgacaauaccuguauggaaagcgugaagaacggcacauacgauuauccuaaauacucugaggaagcuaagcugaaucgcgaggagaucgacgggguuaaacuugaauccaccagaaucuaucaaauucuggccaucuacagcacaguggcguccucucucguccuggugguuagccugggcgcuauuuccuuuuggaugugcucuaacggaagccuccagugccggaucuguauuuga

SEQ ID NO: 185780 - RNA, 1701 nt, Artificial Sequence; identical to SEQ ID NO: 185680
  derived and/or modified sequence opt5 from hemagglutinin__InfluenzaA__ACR09376

SEQ ID NO: 185781 - RNA, 1701 nt, Artificial Sequence; identical to SEQ ID NO: 185680
  derived and/or modified sequence opt5 from hemagglutinin__InfluenzaA__ACR09377

SEQ ID NO: 185782 - RNA, 1701 nt, Artificial Sequence; identical to SEQ ID NO: 185680
  derived and/or modified sequence opt5 from hemagglutinin__InfluenzaA__ACR09395

SEQ ID NO: 185783 - RNA, 1701 nt, Artificial Sequence; identical to SEQ ID NO: 185680
  derived and/or modified sequence opt5 from hemagglutinin__InfluenzaA__ACR09396

SEQ ID NO: 185784 - RNA, 1701 nt, Artificial Sequence
  derived and/or modified sequence opt5 from hemagglutinin__InfluenzaA__ACR10186
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagaucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 185785 - RNA, 1701 nt, Artificial Sequence; identical to SEQ ID NO: 185784
  derived and/or modified sequence opt5 from hemagglutinin__InfluenzaA__ACR10222

SEQ ID NO: 185786 - RNA, 1701 nt, Artificial Sequence
  derived and/or modified sequence opt5 from hemagglutinin__InfluenzaA__ACR10223
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcuccagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 185787 - RNA, 1701 nt, Artificial Sequence
  derived and/or modified sequence opt5 from hemagglutinin__InfluenzaA__ACR15183
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcgggucugacaacuccuuuuucagcagacugaauuggcucacacaucugaaguuuaaauauccugcccuuaacgucaccaugcccaauaacgagaaguucgauaaacuguacaucuggggagugcaccauccuggcacggacaacgaucagauuuuuccguaugcgcaggccucugggcggaucacaguuuccaccaagcgcagccaacagacagugauucccaauaucggauccagaccucggguccgcaacauucccucuagaaucagcaucuacuggaccauugugaaaccuggcgacauccuccugauuaauuccaccgggaaccugaucgcuccccggggauacuucaagauucgcagcggcaagucuuccaucaugagaagcgacgccccgaucggcaaauguaauucugagugcauuacaccuaacgggagcauccccaaugauaagccuuuucagaacgugaaucggauuacguauggagcuuguccccgcuacgucaaacagaacacccucaagcuggccacaggcaugagaaauguucccgaaaaacaaacccgggggaucuucggagcgauugccggcuuuaucgagaacgggugggaaggaaugguggacggcugguauggcuuccgccaccaaaauuccgaggggaucggacaggcugccgaucuuaagucuacacaggcugccauuaaccagaucaauggcaaacugaacagacucauugggaagaccaacgagaaguuccaccagaucgaaaaagaguuuagcgaaguggagggacggauucaggaccuggaaaaguacgucgaggauacgaaaaucgaccuuugguccuauaaugccgagcugcucguggcucuggaaaaccaacauacaauugaucugaccgacagcgagaugaauaaacucuucgaaagaaccaagaagcagcugcgcgagaacgcggaagauaugggcaaugggugcuuuaagaucuaccacaaaugugacaacgccugcaucggcucuauucggaauggaacauaugaucaugacguuuacagagacgaggcucuuaacaaucgcuuccagaucaagggcguggagcugaaauccggguacaaggauuggauucucuggaucagcuuugccauuucuugcuuccugcuuugugucgcccugcucggauuuaucaugugggcuugccagaaaggcaacauccgguguaauauuugcaucuga

SEQ ID NO: 185788 - RNA, 1698 nt, Artificial Sequence
  derived and/or modified sequence opt5 from hemagglutinin__InfluenzaA__ACR15194
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcaaucagaaagcccuguaccauaccgagaacgcuuacgugagcgucguuuccucucacuauagcagaaaguucacacccgaaauugccaagcggccuaaagugcgcgaccaggaggggagaaucaauuacuauuggacccuucuggagcccggagauacgauuaucuuugaagcgaacggcaaucucauugccccucgguacgcuuucgcccugucccgcgggcuuggaagcggcaucauuaacucuaaugcucccauggacaagugugaugccaaaugccagacaccgcaaggcgcgaucaacuccagccugccuuuucagaaugugcaucccgucaccaucggggaguguccuaaguaugugagaucugccaaacuccggaugguuacaggacugcgcaacauucccagcauccaguccagaggccuguucggggcuauugccggauuuaucgaaggcggguggaccggaaugguggacggcugguacggcuaucaccaccagaaugagcaagggucuggauacgcugccgaucaaaagagcacccagaacgccauuaauggcaucacaaacaaagucaauuccgugaucgaaaagaugaacacgcaguucaccgcuguugggaaggaguuuaacaaacucgagcggcgcauggaaaaucugaacaagaaaguggacgauggauucauugacaucuggacauacaaugcggagcuucugguccuccuggaaaacgagagaacccuugauuuccaugacagcaaugugaagaaccuguaugaaaaagucaagucucagcucaagaauaacgccaaagagauuggcaaucggugcuuugaguucuaccacaaguguaacgacgaaugcauggaguccgugaaaaaugggacauaugauuaccccaaguauagcgaagagucuaaacugaaccgcgagaagaucgacggcguuaagcuggaauccaugggaguguaccagauucucgcuaucuauagcaccgucgccuccucucuggugcuucugguuagccucggcgccaucuccuuuuggaugugcucuaaugggagccugcaguguagaauuugcaucuga

SEQ ID NO: 185789 - RNA, 1698 nt, Artificial Sequence; identical to SEQ ID NO: 183894
  derived and/or modified sequence opt5 from hemagglutinin__InfluenzaA__ACR15216

SEQ ID NO: 185790 - RNA, 1701 nt, Artificial Sequence
  derived and/or modified sequence opt5 from hemagglutinin__InfluenzaA__ACR15227
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugccagcgcagaucuaacaaguccuuuuucagccggcugaauuggcucacacaucugaaguuuaaauauccugcccuuaacgucaccaugcccaauaacgagaaguucgacaaacuguacaucuggggagugcaccauccugggacggauaacgaccagauuucucucuaugcgcaaacauccggccgcaucaccguuagcacaaagagaucccagcagaccgugauuccgaauaucgggucucggccccgcgucagagaugugccuagccggauuuccaucuacuggaccaucgugaaacccggagacauucugcugaucaacagcacaggcaaucucauugccccucgcggguacuuuaagaucagaucuggaaaguccagcauuaugcggucugacgcucccaucggcaaauguaacagcgagugcaucacgccgaauggcuccauuccuaacgauaagcccuuccagaaugucaaccgcaucaccuauggggccuguccuagauacguuaaacaaaauacacugaagcuggcuaccggaaugcggaacgugcccgaacgccagacaagaggcauuuuuggggccaucgcgggauucauugagaauggcugggaagggaugauggacggaugguauggcuuucggcaccagaacucugagggcaccgggcaagccgcugaucuuaaaagcacgcaggccgcuaucaaucagaucaacggaaagcucaauagacugauuggcaaaacaaacgagaaguuccaccagaucgaaaaggaguucuccgaaguggaggggcgcauucaagaccuugaaaaauacgucgaggauaccaagaucgaccuguggagcuauaacgccgagcuccugguggcccuggaaaaucagcauaccauugaucucacagacucugagaugaacaaacuguuugaacggaccaagaaacagcuuagagagaaugcugaagauaugggaaacggcugcuucaagaucuaccacaagugugacaaugcgugcauuggguccauccgcaacggcacauaugaucaugacguuuaccgggacgaggcccugaauaacagauuucagaucaaaggaguggagcucaagagcggcuacaaagauuggauucuguggaucucuuucgcuauuuccugcuuucuucugugugucgcccuccugggguucaucaugugggccugccaaaagggaaauauucgcuguaacaucugcaucuga

SEQ ID NO: 185791 - RNA, 1698 nt, Artificial Sequence
  derived and/or modified sequence opt5 from hemagglutinin__InfluenzaA__ACR15238
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgugcagaaagcccuguaccauaccgagaaugcuuacgucagcguuguguccucucacuauagcagaaaguucacacccgaaauugccaagcggccuaaagugcgcgaccaggaggggagaaucaacuacuauuggacccuucuggagcccggagauacgauuaucuuugaagcgaauggcaaccucauugccccucgguacgcuuucgcccugucccgcggguuuggaagcggcaucauuaauucuaacgcucccauggacaagugugaugccaaaugccagacaccgcaaggcgcgaucaauuccagccuuccuuuccagaacguccaucccgugaccaucggggaguguccuaaguauguuagaucugccaaacugcggauggugacaggacuccgcaauauucccagcauccaguccagaggccuguuuggggcuauugccggauucaucgaaggcggguggaccggaauggucgacggcugguacggcuaucagcaccaaaacgagcaggggucuggauacgcugccgaucaaaagagcacccagaaugccauuaacggcaucacaaauaaagugaacuccguuaucgaaaagaugaauacgcaguuuaccgcuguggggaaggaguucaacaaacuggagcggcgcauggaaaaccucaauaagaaagucgacgauggauucauugacaucuggacauacaacgcggagcugcuugugcugcucgaaaaugagagaacccuggauuuucacgacagcaacgucaagaaucuuuaugaaaaagugaagucucagcugaagaacaaugccaaagagauuggcaacgggugcuucgaguuuuaccauaaguguaaugacgaaugcauggaguccguuaaaaacggcacauaugauuaccccaaguauagcgaagagucuaaacucaaucgggagaagaucgacggagugaagcuggaauccaugggcgucuaccagauucuggcuaucuauagcaccguggccuccucucucguucugcuugugagccugggggccaucuccuucuggaugugcucuaacggaagccuccaaugucgcauuugcaucuga

SEQ ID NO: 185792 - RNA, 1701 nt, Artificial Sequence
  derived and/or modified sequence opt5 from hemagglutinin__InfluenzaA__ACR15249
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgagaaauucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaagcccggggauauucuccugaucaacagcaccggaaaucugauugcuccucgcggcuacuucaaaaucagaucugggaaguccagcaucaugcggucugacgcccccauuggaaaguguaacagcgaaugcaucacaccgaauggcuccauuccuaacgacaaacccuuucagaaugugaaccgcaucacguauggcgcuuguccuagauacgucaagcagaauacccucaaacuggccacagggaugcggaacguucccgagaagcaaacccgcggaauuuucggcgcgaucgccggguuuaucgaaaauggaugggagggcaugguggaugggugguauggauucagacaccagaacucugagggcauuggccaggcugccgaccuuaaaagcacacaagcugccaucgaucagauuaaugggaagcugaaccggcucaucggaaaaaccaacgaaaaguuccaccagauugagaaggaauuuuccgagguggaaggcagaauccaggaccuggagaaauacgucgaggauacgaagauugaccuuuggagcuauaaugccgaacugcucguggcucuggagaaccaacauacaaucgaucugaccgacucugaaaugaauaaacucuucgagaagaccaaaaagcagcugcgcgaaaacgcggaggauauggggaauggaugcuuuaagaucuaccacaaaugugacaacgccugcauuggcuccauccggaaugggacauaugaucaugacguuuacagagacgaggcucuuaacaaucgcuuccagauuaagggcguggaacugaaaagcggauacaaggauuggauccucuggauuucuuuugccaucuccugcuuccugcuuugugucgcccugcucggcuuuaucaugugggcuugccagaaagggaacauucgguguaauaucugcauuuga

SEQ ID NO: 185793 - RNA, 1701 nt, Artificial Sequence
  derived and/or modified sequence opt5 from hemagglutinin__InfluenzaA__ACR15282
augaagaccaucauugcccugagcuacauccucugccugguguucgcucagaaacuucccggcaacgacaauuccacagccacgcugugucucgggcaccaugcggucccuaacggaaccauuguuaagacaaucaugaaugaucaaauugaggugaccaacgcuacagaacuggugcagucuagcuccaccggcgagaucugcgacucuccgcaccagauccuugauggggaaaauuguacacugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacgggagugacccagaauggcacauccagcgcuugcauccgcagaucuaacaauuccuuuuucagccggcugaacuggcucacccauucuaaguuuaaguauccugcccugaaugucacaaugcccaacaacgagaaauucgacaaacuuuacauuuggggcgugcaccauccugggaccgauaaugaccagaucuuucuguaugcgcaggccuccggacgcauuacgguuagcacaaagagaucccaacagaccgugaucccgaacauuggcucucggccccgcgucagaaauaucccuagccggaucuccauuuacuggacaaucgugaagcccggggauauucuccugaucaacagcaccggaaaucugauugcuccucgcggcuacuucaaaaucagaucugggaaguccagcaucaugcggucugacgcccccauuggaaaguguaacagcgaaugcaucaccccgaauggcuccauuccuaacgacaaacccuuucagaaugugaaccgcaucacauauggcgcuuguccuagauacgucaagcagaauacgcucaaacuggccaccgggaugcggaacguucccgagaagcaaacacgcggaauuuucggcgcgaucgccggguuuaucgaaaauggaugggagggcaugguggaugggugguauggauucagacaccagaacucugagggcauuggccaggcugccgaccuuaaaagcacccaagcugccaucgaucagauuaaugggaagcugaaccggcucaucggaaaaacaaacgaaaaguuccaccagauugagaaggaauuuuccgagguggaaggcagaauccaggaccuggagaaauacgucgaggauaccaagauugaccuuuggagcuauaaugccgaacugcucguggcucuggagaaccaacauacgaucgaucugacagacucugaaaugaauaaacucuucgagaagaccaaaaagcagcugcgcgaaaacgcggaggauauggggaauggaugcuuuaagaucuaccacaaaugugacaacgccugcauuggcuccauccggaaugggaccuaugaucaugacguuuacagagacgaggcucuuaacaaucgcuuccagauuaagggcguggaacugaaaagcggauacaaggauuggauccucuggauuucuuuugccaucuccugcuuccugcuuugugucgcccugcucggcuuuaucaugugggcuugccagaaagggaacauucgguguaauaucugcauuuga

SEQ ID NO: 185794 - RNA, 1701 nt, Artificial Sequence
  derived and/or modified sequence opt5 from hemagglutinin__InfluenzaA__ACR15293
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugaucgccuccagcggaacgcuugaguuuaacaaugaaaacuucaauuggaccggcguuacacagaacggcaccucuuccgcuugcaagcgcgggagcgacaauuccuuuuucucuagacugaacuggcucacacaucugaaguuuaaauauccugcccuuaaggugaccaugcccaauaacgagaaauucgauaagcuguacauuuggggaguccaccauccuggcacggacaacgaucagaucuuucucuaugcgcaggccagcgggcggauuacagugucuaccaaacgcucccaacagacaguuaucccgaauauuggaagcagaccccgggugcgcaacaucccuuccagaaucucuauuuacuggaccaucgucaagcccggcgacauucugcugaucaauagcaccgggaaccucauugcuccucggggauacuucaagauccgcuccggcaaaagcucuaucaugagauccgacgcccccauuggcaaguguaauagcgagugcaucacaccgaacgggucuauuccuaaugauaaacccuuucagaacgugaaucggaucacguauggagcuuguccucgcuacgugaagcagaacacccugaaacuugccacaggcaugagaaauguccccgaaaagcaaacccgggggauuuucggagcgaucgccggcuuuaucgagaacgggugggaaggaaugguugacggcugguauggcuuccgccaccagaauagcgaggggauuggacaggcugccgaucugaaauccacacaagcugccaucaaccagauuaauggcaagcucaacagacugaucgggaagaccaacgagaaauuccaccagauugaaaaggaguuuucugaaguggagggacggauccaggaccuugaaaaauacguggaggauacgaagauugaccuguggagcuauaaugccgagcuccuggucgcucuggaaaaccaacauacaaucgaucucaccgacuccgagaugaauaaacuguucgaaagaaccaagaagcagcuucgcgagaacgcggaagauaugggcaaugggugcuuuaaaaucuaccacaagugugacaacgccugcauuggcagcauccggaauggaacauaugaucaugacguguacagagacgaggcucugaacaaucgcuuccagauuaaaggcguugagcucaagucuggguacaaagauuggauccuguggauuuccuuugccaucagcugcuuccuucuguguguggcccuccugggauuuaucaugugggcuugccagaagggcaacauucgguguaauaucugcauuuga

SEQ ID NO: 185795 - RNA, 1698 nt, Artificial Sequence
  derived and/or modified sequence opt5 from hemagglutinin__InfluenzaA__ACR15304
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaaggagagcucuuggccuaaucauaccgucacaggaguguccgcuagcugcucucacaacggcaaguccagcuuuuaccgcaaucugcuuuggcugaccggcaaaaacgggcucuaucccaaucugucuaaguccuacgccaacaauaaagaaaaggagguucuggugcucuggggaguccaucacccuccgaacacaggcaaccagagagcucuguaccacaccgaaaaugccuaugugagcguggucuccucucauuacagccggcgcuucacgcccgagaucgcgaaaagaccuaagguucgggaucaggaagggcgcauuaacuauuacuggacacuucuggagcccggagacaccaucauuuuugaggccaauggcaaccucaucgcuccuugguaugccuucgcucuguccagaggguuuggaagcggcauuaucacaucuaaugcccccauggaugaaugugacgcgaagugccagaccccgcaaggcgccauuaacuccagccuuccuuuccagaaugugcaccccgugaccaucggggaguguccuaaauacguccggucugcuaagcugcgcauggugacaggacucagaaacauccccagcauucagucccggggccuguuuggggccaucgcuggauucauugaaggcggguggacgggaaugguugauggcugguauggcuaccaucaccagaaugagcaagggucuggauacgccgccgaccagaaaagcacccagaacgcuaucaauggcauuacaaacaaggucaauuccgugaucgaaaagaugaacacccaguuuacagcgguggggaaagaguucaaucgccuggagagacggauggaaaaccucaacaaaaagguugaugacggauuccuggauaucuggaccuauaaugccgagcuucuggugcuccuggaaaacgagcgcacgcuugacuuucacgacagcaaugucaagaaccuguacgaaaaagugaagucucaacucaaaaauaacgcuaaggagauuggcaaugggugcuucgaguuuuaucauaaauguaacaaugaaugcauggaguccgucaagaacggcacauacgauuaucccaaguacagcgaagagucuaaacugaauagagagaagaucgacggagugaaacuggaauccaugggcguuuaucagauucucgccaucuacagcaccguggccuccucucugguccuucuggugagccucggggcuauuuccuucuggaugugcucuaacggaagccugcagugucggaucugcaucuga

SEQ ID NO: 185796 - RNA, 1698 nt, Artificial Sequence
  derived and/or modified sequence opt5 from hemagglutinin__InfluenzaA__ACR15315
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucagagaucagcgggcccuguaccacacagagaacgcuuaugugagcgucguuuccucucauuacagccgcagauucacccccgaaauugccaagcggccuaaagugcgcgaccaggaggggagaaucaauuauuacuggacgcuucuggaacccggagauacaauuaucuuugaggcgaacggcaaucucauugccccuugguaugcuuucgcccugucccggggguuuggaagcggcaucauuaccucuaacgcucccaugggcgagugugacgccaagugccagacaccgcaaggggcgaucaauuccagccuuccuuuccagaacgugcaccccgucaccaucggagaauguccuaaguacgugcgcucugccaaacugagaaugguuaccggccuccggaauauucccagcauccagucccgcgggcuguuuggagcuauugccggcuucaucgaagggggauggacaggcaugguggauggcugguauggguaccaucaccagaacgaacaaggaucuggcuacgcugccgaccaaaagagcacgcagaaugccauuaacgggaucaccaauaaagucaacuccgugaucgagaagaugaauacacaguuuaccgcuguuggaaaagaguucaacaagcuggagagacggauggagaaucucaacaaaaagguggaugacggcuuccuggauauuuggacauauaacgcggaacuucugguccuccuggagaaugaacgcacccuugacuuucacgacagcaacgugaagaaucuguacgagaaagucaagucucagcucaaaaacaaugccaaggaaaucgggaacggcugcuucgaguuuuaucauaaauguaauaacgagugcauggaauccgugaagaauggaacguacgauuaucccaaguacagcgaggaaucuaaacugaacagagagaagauugacggcguuaaacuggaguccauggggguguaucagauccucgcuauuuacagcacagucgccuccucucuggugcuucugguuagccucggagccaucuccuucuggaugugcucuaauggcagccugcagugucggaucugcauuuga

SEQ ID NO: 185797 - RNA, 1698 nt, Artificial Sequence
  derived and/or modified sequence opt5 from hemagglutinin__InfluenzaA__ACR15326
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaacugcuuaucuccaaagagucuuggagcuacauuguugaaaccccgaaucccgagaacggcacguguuauccuggguacuuugccgacuaugaggaacugagagagcaacucuccucugugagcuccuucgaacgguuugagaucuuccccaagggaagcucuuggccuaaucauaccgucacaggcguguccgcuagcugcucucacaacggcaaguccagcuuuuaccgcaaucugcuuuggcugaccgggaaaaacggacucuaucccaaucugucuauguccuacguuaacaauaaggagaaagaagugcugguccucuggggcgugcaucacccuccgaacaucgggaaccagagagcccuguaccacacagagaaugcuuaugugagcgucguuuccucucauuacagccggcgcuucacccccgaaauugccaagagaccuaaagugcgggaucaggagggacgcaucaacuauuacuggacgcuucuggaacccggcgacacaauuaucuuugaggcgaaugggaaccucauugccccuugguaugcuuucgcccuguccagaggauuuggcagcggcaucauuaccucuaaugcucccaugggggagugugaugaaaagugccagacaccgcaaggagccaucaacuccagccuuccuuuccagaaugugcaccccgucaccaucggcgaguguccuaaguacgugcggucugcgaaacugcgcaugguuaccgggcucagaaacauucccagcauccagucccggggacuguuuggcgccauugcuggguucaucgaaggaggcuggacaggcaugguggacgggugguauggauaccaucaccagaaugagcaaggcucuggguacgccgcugaucaaaagagcacgcagaacgccauuaauggaaucaccaacaaagucaauuccgugaucgaaaagaugaacacacaguuuaccgccguuggcaaagaguucaauaagcuggagcgcagaauggaaaaccucaacaaaaagguggacgauggguuccuggacauuuggacauauaaugcugagcuucugguccuccuggaaaacgagcggacccuugauuuucacgacagcaaugugaagaaccuguacgaaaaagucaagucucagcucaaaaauaacgcgaaggagaucggcaauggaugcuucgaguuuuaucauaaauguaacaaugaaugcauggaguccgugaagaacggcacguacgacuaucccaaguacagcgaagagucuaaacugaaucgcgagaagauugaugggguuaaacuggaauccaugggaguguaucagauccucgccauuuacagcacagucgcuuccucucuggugcuucugguuagccucggcgccaucuccuucuggaugugcucuaacgggagccugcaguguagaaucugcauuuga

SEQ ID NO: 185798 - RNA, 1698 nt, Artificial Sequence
  derived and/or modified sequence opt5 from hemagglutinin__InfluenzaA__ACR15359
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcggccugcuuaucuccaaagaaucuuggagcuacauuguggagaagccgaaccccgaaaaugggaccuguuauccuggacauuuugccgauuacgaggagcugagagaacaacucuccucugucagcuccuucgagcgguuugaaaucuuccccaaggagagcucuuggccuaaccacacggugaccggcguuuccgccagcugcucucauaauggcgaguccagcuuuuaucgcaaccugcuuuggcugacagggaaaaauggacucuaccccaaccugucuaaguccuaugcuaauaacaaagaaaaggaggugcugguccucuggggcgugcaccacccuccgaacaucggggaccagaaagcccuguaccauaccgaaaaugcuuacgugagcgucguuuccucucacuauagcagaaaguucacacccgagauugccaagcggccuaaagugcgcgaucaggaaggaagaaucaacuacuauuggacccuucuggagcccggcgacacgauuaucuuugaggcgaaugggaaccucauugccccucgguacgcuuucgcccugucccgcggauuuggcagcggcaucauuaauucuaacgcucccauggauaagugugacgccaaaugccagacaccgcaaggggcgaucaauuccagccuuccuuuccagaacgugcaucccgucaccaucggagaauguccuaaguaugugagaucugccaaacugcggaugguuacaggccuccgcaauauucccagcauccaguccagagggcuguuuggagcuauugccggcuucaucgaagggggauggaccggcaugguggauggcugguacggguaucaccaccagaacgaacaaggaucuggcuacgcugccgaccaaaagagcacccagaaugccauuaacgggaucacaaauaaagucaacuccgugaucgagaagaugaauacgcaguuuaccgcuguuggaaaggaguucaacaaacuggagcggcgcauggagaaccucaauaagaaaguggaugacggcuucauugauaucuggacauacaacgcggaacugcuuguccugcucgagaaugaaagaacccuggacuuucaugacagcaacgugaagaaucuuuaugagaaagucaagucucagcugaagaacaaugccaaagaaauugggaacggcugcuucgaguuuuaccacaaguguaaugaugagugcauggaauccgugaaaaacggaacauaugacuaccccaaguauagcgaggaaucuaaacucaaucgggagaagaucgauggcguuaagcuggaguccauggggguguaccagauucuggcuaucuauagcaccgucgccuccucucucgugcugcuuguuagccugggagccaucuccuucuggaugugcucuaacggcagccuccagugucgcauuugcaucuga

SEQ ID NO: 185799 - RNA, 1698 nt, Artificial Sequence
  derived and/or modified sequence opt5 from hemagglutinin__InfluenzaA__ACR15370
augaaggugaaacugcucguccugcuuugcacccugacagccacguacgcugacaccaucuguauuggcuaucacgccaacaauagcacagauaccguugacacagugcucgagaagaacgugaccgucacacauuccgugaaucugcuugaaaacucucacaaugggaaacugugccuccugaagggaaucgcgccccugcagcucggcaacuguagcguugcuggguggauucugggaaauccugagugcgaacuucugaucuccaaagagucuuggagcuacauuguggaaaagccgaaccccgagaauggcaccuguuauccugggcauuucgccgauuacgaggaacucagagagcaacuguccucugucagcuccuuugaacgguucgagaucuuucccaaggagagcucuuggccuaaccacacggugaccggaguuuccgccagcugcucucauaauggcgaauccagcuucuaucgcaaccuucuguggcucacaggcaaaaaugggcuguaccccaaccugucuaaguccuaugcuaauaacaaagagaaggaagugcucguccuguggggagugcaccacccuccgaacaucggcgaccagaaagcccuuuaccauaccgagaaugcuuacgugagcgucguuuccucucacuauagcagaaaguuuacacccgaaauugccaagcggccuaaagugcgcgaucaggaggggagaaucaacuacuauuggacccugcucgagcccggagacacgauuaucuucgaagcgaauggcaaccugauugccccucgguacgcuuuugcccuuucccgcggguucggaagcggcaucauuaauucuaacgcucccauggauaagugugacgccaaaugccagacaccgcaaggcgcgaucaauuccagccugccuuuucagaacgugcaucccgucaccaucggggaguguccuaaguaugugagaucugccaaacuccggaugguuacaggacugcgcaauauucccagcauccaguccagaggccuguucggggcuauugccggauuuaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguucaccgcuguugggaaggaguuuaacaaacucgagcggcgcauggaaaaccugaauaagaaaguggaugacggauucauugauaucuggacauacaacgcggagcuucugguccuccuggaaaaugagagaacccuugacuuccaugacagcaacgugaagaaucuguaugaaaaagucaagucucagcucaagaacaaugccaaagagauuggcaacgggugcuuugaguucuaccacaaguguaaugaugaaugcauggaguccgugaaaaacggcacauaugacuaccccaaguauagcgaagagucuaaacugaaucgggagaagaucgauggaguuaagcuggaauccaugggcguguaccagauucucgcuaucuauagcaccgucgccuccucucugauccuucuggugagccucggggccauuuccuuuuggaugugcucuaacggaagccugcagugucgcaucugcauuuga

SEQ ID NO: 185800 - RNA, 1701 nt, Artificial Sequence; identical to SEQ ID NO: 185325
  derived and/or modified sequence opt5 from hemagglutinin__InfluenzaA__ACR15381

SEQ ID NO: 185801 - RNA, 1701 nt, Artificial Sequence; identical to SEQ ID NO: 185332
  derived and/or modified sequence opt5 from hemagglutinin__InfluenzaA__ACR15392

SEQ ID NO: 185802 - RNA, 1701 nt, Artificial Sequence; identical to SEQ ID NO: 184952
  derived and/or modified sequence opt5 from hemagglutinin__InfluenzaA__ACR15403

SEQ ID NO: 185803 - RNA, 1701 nt, Artificial Sequence; identical to SEQ ID NO: 184952
  derived and/or modified sequence opt5 from hemagglutinin__InfluenzaA__ACR15414

SEQ ID NO: 185804 - RNA, 1698 nt, Artificial Sequence; identical to SEQ ID NO: 185798
  derived and/or modified sequence opt5 from hemagglutinin__InfluenzaA__ACR15425

SEQ ID NO: 185805 - RNA, 1698 nt, Artificial Sequence
  derived and/or modified sequence opt5 from hemagglutinin__InfluenzaA__ACR15436
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaaggaaaggaggugcugguccucuggggcgugcaccacccuccgaacaucggggaccagaauacccuguaccauacagaaaacgccuacgugagcgucguuuccucucacuauagcagaaaauucacccccgagauugcuaagcggccuaaggugcgcgaucaggaaggaagaaucaauuacuauuggacgcuucuggagcccggcgacacaauuaucuuugaggccaacgggaaucucauugcgccucgguacgccuucgcucugucccgcggauuuggcagcggcaucauuaacucuaaugcccccauggauaaaugugacgcuaagugccagaccccgcaaggggccaucaacuccagccuuccuuuccagaaugugcaucccgucacaaucggagaauguccuaaauaugugagaucugcgaagcugcggaugguuaccggccuccgcaacauucccagcauccaguccagagggcuguuuggagccauugcuggcuucaucgaagggggauggaccggcaugguggauggcugguacggguaucaccaccagaaugaacaaggaucuggcuacgccgcugaccagaaaagcacacagaacgccauuaaugggaucacgaacaaggucaauuccgugaucgagaaaaugaacacccaguuuacagccguuggaaaggaguucaacaagcuggagcggcgcauggagaaucucaacaaaaagguggaugacggcuucauugauaucuggaccuacaaugcugaacugcuuguccugcucgagaacgaaagaacacuggacuuucaugacagcaaugugaaaaaccuuuaugagaaggucaaaucucaacugaagaauaacgcgaaggaaauugggaauggcugcuucgaguuuuaccacaaauguaacgaugagugcauggaauccgugaagaauggaaccuaugacuaccccaaauauagcgaggaaucuaagcucaaccgggagaaaaucgauggcguuaagcuggaguccauggggguguaccagauucuggccaucuauagcacggucgcuuccucucucgugcugcuuguuagccugggagccaucuccuucuggaugugcucuaauggcagccuccagugucgcauuugcaucuga

SEQ ID NO: 185806 - RNA, 1698 nt, Artificial Sequence
  derived and/or modified sequence opt5 from hemagglutinin__InfluenzaA__ACR15458
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaacccgaaucccgagaacggcaccuguuauccugggcauuuugccgauuacgaggaacugagagagcaacucuccucugucagcuccuucgaacgguuugagaucuuccccaaggagagcucuuggccuaaucacacggugaccggaguuuccgccagcugcucucauaacggcgaauccagcuuuuaucgcaaucugcuuuggcugacaggcaagaacgggcucuaccccaaucugucuaaauccuaugcuaacaacaaggagaaagaagugcugguccucuggggagugcaccacccuccgaauaucggcgaccagaaggcccuguaccauaccgagaacgcuuacgugagcgucguuuccucucacuauagcagaaaauucacacccgaaauugccaagcggccuaaggugcgcgaucaggaggggagaaucaauuacuauuggacccuucuggagcccggagacacgauuaucuuugaagcgaacggcaaucucauugccccucgguacgcuuucgcccugucccgcggguuuggaagcggcaucauuaacucuaaugcucccauggauaaaugugacgccaagugccagacaccgcaaggcgcgaucaacuccagccuuccuuuccagaaugugcaucccgucaccaucggggaguguccuaaauaugugagaucugccaagcugcggaugguuacaggacuccgcaacauucccagcauccaguccagaggccuguuuggggcuauugccggauucaucgaaggcggguggaccggaaugguggauggcugguacggcuaucaccaccagaaugagcaagggucuggauacgcugccgaccagaaaagcacccagaacgccauuaauggcaucacaaacaaggucaauuccgugaucgaaaagaugaacacgcaguuuaccgcuguugggaaagaguucaacaagcuggagcggcgcauggaaaaucucaacaaaaagguggaugacggauucauugauaucuggacauacaaugcggagcugcuuguccugcucgaaaacgagagaacccuggacuuucaugacagcaaugugaaaaaccuuuaugaaaaggucaaaucucaacugaagaauaacgccaaggagauuggcaaugggugcuucgaguuuuaccacaaauguaacgaugaaugcauggaguccgugaagaauggcacauaugacuaccccaaauauagcgaagagucuaagcucaaccgggagaaaaucgauggaguuaagcuggaauccaugggcguguaccagauucuggcuaucuauagcaccgucgccuccucucucgugcugcuuguuagccugggggccaucuccuucuggaugugcucuaauggaagccuccagugucgcauuugcaucuga

SEQ ID NO: 185807 - RNA, 1698 nt, Artificial Sequence
  derived and/or modified sequence opt5 from hemagglutinin__InfluenzaA__ACR15469
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauucucacaacgggaaacuuugccugcucaagggaaucgcgccccugcagcugggcaauuguagcguugcuggguggauucucggaaacccugagugcgaacugcuuaucuccaaagagucuuggagcuacauuguggaaaagccggaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaauaucggcgaccagaacacccuguaccauacagagaacgccuacgugagcgucguuuccucucacuauagcagaaaauucacccccgaaauugcuaagcggccuaaggugcgcgaucaggaggggagaaucaauuacuauuggacgcuucuggagcccggagacacaauuaucuuugaagccaacggcaaucucauugcgccucgguacgccuucgcucugucccgcggguuuggaagcggcaucauuaacucuaaugcccccauggauaaaugugacgcuaagugccagaccccgcaaggcgccaucaacuccagccuuccuuuccagaaugugcaucccgucacaaucggggaguguccuaaauaugugagaucugcgaagcugcggaugguuaccggacuccgcaacauucccagcauccaguccagaggccuguuuggggccauugcuggauucaucgaaggcggguggaccggaaugguggauggcugguacggcuaucaccaccagaaugagcaagggucuggauacgccgcugaccagaaaagcacacagaacgccauuaauggcaucacgaacaaggucaauuccgugaucgaaaagaugaacacccaguuuacagccguugggaaagaguucaauaagcuggagcggcgcauggaaaaccucaacaaaaagguggaugacggauucauugacaucuggaccuacaaugcugagcugcuuguccugcucgaaaacgagagaacacuggauuuucaugacagcaaugugaaaaaccuuuaugaaaaggucaaaucucaacugaagaauaacgcgaaggagauuggcaaugggugcuucgaguuuuaccacaaauguaacgaugaaugcauggaguccgugaagaauggcaccuaugacuaccccaaauauagcgaagagucuaagcucaaccgggagaaaaucgauggaguuaagcuggaauccaugggcguguaccagauucuggccaucuauagcacggucgcuuccucucucgugcugcuuguuagccugggggccaucuccuucuggaugugcucuaauggaagccuccagugucgcauuugcaucuga

SEQ ID NO: 185808 - RNA, 1698 nt, Artificial Sequence; identical to SEQ ID NO: 185805
  derived and/or modified sequence opt5 from hemagglutinin__InfluenzaA__ACR15480

SEQ ID NO: 185809 - RNA, 1698 nt, Artificial Sequence
  derived and/or modified sequence opt5 from hemagglutinin__InfluenzaA__ACR15491
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcagaaaugggcucuaccccaaccugucuaaauccuaugcuaauaacaaggagaaagaagugcugguccucuggggagugcaccacccuccgaacaucguggaccagaagacccuguaccggacagagaaugccuacgucagcguuguguccucucauuauagccgcaaauucacccccgaaauugcuaagagaccuaaggugcgggaucaggagggccgcaucaacuacuauuggacgcuucuggagcccggggacacaauuaucuuugaagccaauggaaaccucauugcgccuagauacgccuucgcucugucccggggcuuugggagcggaaucauuaauucuaacgcccccauggauaaaugugacgcuaagugccagaccccgcaaggcgccaucaauuccagccuuccuuuccagaacguccaccccgugacaaucggcgaguguccuaaauauguucgcucugcgaagcugagaauggugaccgggcuccggaauauucccagcauccagucccgcggacuguuuggcgccauugcuggguucaucgaaggaggcuggaccgggauggucgauggaugguacggcuaucaucaccagaacgagcaaggcucuggguacgccgcugaccagaaaagcacacagaaugccauuaacggaaucacgaauaaggugaacuccguuaucgaaaagaugaauacccaguuuacagccgugggcaaagaguucaacaagcuggagagacggauggaaaaccucaauaaaaaggucgaugacggguucauugauaucuggaccuacaacgcugagcugcuugugcugcucgaaaaugagcgcacacuggacuuucacgacagcaacgucaaaaaucuuuaugaaaaggugaaaucucaacugaagaacaaugcgaaggagauuggaaacggcugcuucgaguuuuaccauaaauguaaugaugaaugcauggaguccguuaagaacgggaccuaugacuaccccaaauauagcgaagagucuaagcucaauagagagaaaaucgauggcauuaagcuggaauccaugggaguguaccagauccuggccaucuauagcacggucgcuuccucucucgugcugcuuguuagccugggcgccauuuccuucuggaugugcucuaacgggagccuccagugucggaucugcauuuga

SEQ ID NO: 185810 - RNA, 1698 nt, Artificial Sequence
  derived and/or modified sequence opt5 from hemagglutinin__InfluenzaA__ACR15502
augaaggugaaacugcucguccugcuuugcaccuucacagccacguacgcugacaccaucuguauuggcuaucacgccaacaaugcgacagauaccguugacacagugcuggagaagaacgugaccgucacacauagcgugaaucuccuggaaaacucccacaaugggaaacuuugccugcucaagggaaucgcuccccugcagcugggcaacuguucuguugccggguggauucucggaaauccugagugcgaacugcuuaucagcaaagaguccuggucuuacauuguggaaaagccgaaccccgagaauggcaccuguuauccugggcauuuugccgauuacgaggaacugagagagcaacucagcuccgucucuagcuucgaacgguuugagaucuuccccaaggaguccagcuggccuaaccacacggugaccggaguuucugcuuccugcagccauaauggcgaaucuuccuuuuaucgcaaccugcuuuggcugacaggcaaaaaugggcucuaccccaaccugagcaagucuuaugccaauaacaaaggaaaggaggugcugguccucuggggcgugcaccacccuccgaacaucggggaccagaauacccuguaccauacagaaaacgcuuacguguccgucguuagcucccacuauucuagaaaauucacccccgagauugccaagcggccuaaggugcgcgaucaggaaggaagaaucaauuacuauuggacgcuucuggagcccggcgacacaauuaucuuugaggcgaacgggaaucucauugccccucgguacgcuuucgcccugagccgcggauuuggcuccggcaucauuaacagcaaugcucccauggauaaaugugacgccaagugccagaccccgcaaggggcgaucaacucuucccuuccuuuccagaaugugcaucccgucacaaucggagaauguccuaaauaugugagaagcgccaagcugcggaugguuaccggccuccgcaacauucccucuauccagagcagagggcuguuuggagcuauugccggcuucaucgaagggggauggaccggcaugguggauggcugguacggguaucaccaccagaaugaacaaggauccggcuacgcugccgaccagaaaucuacacagaacgccauuaaugggaucacgaacaaggucaauagcgugaucgagaaaaugaacacccaguuuacagcuguuggaaaggaguucaacaagcuggagcggcgcauggagaaucucaacaaaaagguggaugacggcuucauugauaucuggaccuacaaugcggaacugcuuguccugcucgagaacgaaagaacacuggacuuucaugacuccaaugugaaaaaccuuuaugagaaggucaaaagccaacugaagaauaacgccaaggaaauugggaauggcugcuucgaguuuuaccacaaauguaacgaugagugcauggaaucugugaagaauggaaccuaugacuaccccaaauauuccgaggaaagcaagcucaaccgggagaaaaucgauggcguuaagcuggagucuauggggguguaccagauucuggcuaucuauuccacggucgccagcucccucgugcugcuuguuucucugggagccaucagcuucuggaugugcuccaauggcucucuccagugucgcauuugcaucuga

SEQ ID NO: 185811 - RNA, 1698 nt, Artificial Sequence; identical to SEQ ID NO: 185667
  derived and/or modified sequence opt5 from hemagglutinin__InfluenzaA__ACR15513

SEQ ID NO: 185812 - RNA, 1701 nt, Artificial Sequence
  derived and/or modified sequence opt5 from hemagglutinin__InfluenzaA__ACR15524
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaaguccuuuuucagccggcugaauuggcucacacaucugaaauuuaaguauccugcccuuaacgucaccaugcccaauaacgagaaauucgacaagcuguacaucuggggagugcaccauccugggacggauaacgaccagauuucucucuaugcgcaggccuccggccgcaucacaguuagcaccaaaagaucccaacagacagugauuccgaauaucgggucucggccccgcgucagagaugugccuagccggauuuccaucuacuggaccaucgucaagagcggagacauucugcugaucaacucuaccggcaaucucauugcuccccgcggguacuuuaagaucagauccggaaaaagcucuauuaugcggagcgacgccccuaucggcaaguguaacuccgagugcaucacacccaauggcucuauuccgaacgauaaaccuuuccagaaugugaaccgcaucacguauggggcuugucccagauacguuaagcagaauacccugaaacuugccacaggaaugcggaacgugccugaaaagcaaacccgcggcauuuuuggggcgaucgccggauucauugagaauggcugggaagggaugguggacggaugguauggcuuuagacaccagaacagcgagggcacagggcaggcugccgaucugaaauccacccaagcugccaucaaucagaucaacggaaagcucaaucggcugauuggcaagacgaacgagaaauuccaccagaucgaaaaggaguucagcgaagucgaggggcgcauucaggaccuugaaaaauacguggaggauacaaagaucgaccuguggucuuauaacgccgagcuccugguugcucuggaaaaucaacauaccauugaucucaccgacuccgagaugaacaaacuguuugaaagaacaaagaagcagcuucgggagaaugcggaagauaugggaaacggcugcuucaaaaucuaccacaagugugacaaugccugcauugggagcaucagaaacggcaccuaugaucaugacguguaccgcgacgaggcucugaauaaccgguuucagaucaaaggagucgagcucaagucuggcuacaaagauuggauucuguggaucuccuucgccauuagcugcuuucuucugugugugguucuccugggguucaucaugugggccugccagaagggaaauauuagauguaacaucugcaucuga

SEQ ID NO: 185813 - RNA, 1701 nt, Artificial Sequence; identical to SEQ ID NO: 185621
  derived and/or modified sequence opt5 from hemagglutinin__InfluenzaA__ACR15535

SEQ ID NO: 185814 - RNA, 1701 nt, Artificial Sequence
  derived and/or modified sequence opt5 from hemagglutinin__InfluenzaA__ACR15546
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccauauccuugauggagagaauuguacccugauugacgcccuccugggcgauccccagugcgacggguuucagaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacaaaauggcaccuccagcgcuugcaagcgcagaucuaacaauuccuuuuucagccggcugaacuggcucacacaccugaaguuuaaauauccugcccuuaaugucaccaugcccaacaacgagaaguucgacaaacuguacaucuggggagugcaucacccugggacggauaaugaccagauuucucucuaugcgcaggccuccggccgcaucacaguuagcaccaagagaucccagcaaacagugauuccgaacaucgggucucggccccgcgucagagauauuagcucccggaucagcaucuacuggaccauugugaaaccuggagacauccugcugauuaauucuaccggcaaccucaucgcuccccgcggguacuuuaagauuagauccggaaagagcucuaucaugcggagcgacgccccuaucggcaaauguaauuccgagugcauuacacccaacggcucuaucccgaaugauaagccuuuccagaacgugaaucgcauuacguauggggcuugucccagauacgucaaacagaacacccugaaacuugccacaggaaugcggaauguuccugaaacccagacacgcggcaucuuuggggcgauugccggauucaucgagaacggcugggaagggaugguggacggaugguauggcuuuagacaccaaaauagcgagggcaccgggcaggcugccgaucugaaguccacgcaggcugccaucaaccaaauuaauggaaagcucaaccggcugaucggcaaaacaaacgagaaguuccaucagauugaaaaggaguucagcgaaguggaggggagaauccaggaccuugaaaaauacgucgaggauaccaagauugaccuguggucuuauaaugccgagcuccugguggcucuggaaaaccagcacaccaucgaucucacagacuccgagaugaauaaacuguuugaacgcaccaagaaacaacuucgggagaacgcggaagauaugggaaauggcugcuucaagauuuaccauaagugugacaacgccugcaucgggagcaucagaaaugagacauaugaucacgacguuuaccgcgacgaggcucugaacaaucgguuucagauuaaaggcguggaacucaagucuggauacaaagauuggauccuguggauuuccuucgccaucagcugcuuucuucugugugucgcccuccugggcuucauuaugugggcuugccagaaggggaacaucagauguaauaucugcauuuga

SEQ ID NO: 185815 - RNA, 1701 nt, Artificial Sequence; identical to SEQ ID NO: 185396
  derived and/or modified sequence opt5 from hemagglutinin__InfluenzaA__ACR15557

SEQ ID NO: 185816 - RNA, 1701 nt, Artificial Sequence; identical to SEQ ID NO: 183654
  derived and/or modified sequence opt5 from hemagglutinin__InfluenzaA__ACR15568

SEQ ID NO: 185817 - RNA, 1701 nt, Artificial Sequence
  derived and/or modified sequence opt5 from hemagglutinin__InfluenzaA__ACR15579
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuuuucucuaugcgcaggccucuggccgcaucacaguuuccaccaagagaagccaacagacagugauuccgaacaucgggucccggccccgcgucagaaauauuccuucucggaucagcaucuacuggaccauugugaaccccggagauauccugcugauuaauuccaccggcaaccucaucgcuccucgcggguacuucaaaauuagaagcggaaagucuuccaucaugcggagcgacgcccccaucggcaaguguaauucugagugcauuacaccgaacggcagcaucccuaaugacaaacccuuucagaacgugaaucgcauuacguauggggcuuguccuagauacgucaagcagaacacccugaaacuugccacaggaaugcggaauguucccgaaaagcaaacccgcggcaucuucggggcgauugccggauuuaucgagaacggcugggaagggaugguggauggaugguauggcuucagacaccaaaauuccgagggcaucgggcaggcugccgaccugaaaucuacacaggcugccauuaaccagaucaacggaaagcucaaucggcugauuggcaaaaccaacgagaaguuccaccagaucgaaaaggaguuuagcgaaguggaggggcgcauucaggaucuugaaaaauacgucgaggacacgaagaucgaucugugguccuauaaugccgagcuccugguggcucuggaaaaccaacauacaauugaccucaccgauagcgagaugaauaaacuguucgaaagaaccaagaaacagcuucgggagaacgcggaagacaugggaaauggcugcuuuaagaucuaccacaagugugauaacgccugcaucgggucuauuagaaauggcacauaugaccaugauguuuaccgcgacgaggcucugaacaaucgguuccagaucaaaggaguggagcucaaguccggcuacaaagacuggauucuguggaucagcuuugccauuucuugcuuccuucugugugucgcccuccugggguuuaucaugugggcuugccagaagggaaacaucagauguaauauuugcaucuga

SEQ ID NO: 185818 - RNA, 1701 nt, Artificial Sequence
  derived and/or modified sequence opt5 from hemagglutinin__InfluenzaA__ACR15590
augaagaccaucauugcccugagcuacauccucugccugguguucacacagaaacuucccggcaacgacaauuccacggcuacccugugucucgggcaccaugccgucccuaacggaacaauuguuaagaccaucacaaaugaucaaauugaggugaccaacgcgacagaacuggugcagucuagcuccaccggcgggaucugcgacucuccgcaccagauccuugauggagagaauuguacgcugauugacgcucuccugggcgauccccagugcgacggguuucaaaacaaaaagugggaucuguucgucgaaagaagcaaagccuauuccaauuguuacccuuaugacgugcccgauuacgccucucuccggagccugguugcuuccagcggaacccuugaguuuaacaaugaaucuuucaacuggacaggcgugacccagaauggcacauccagcgccugcaagcgcagaucuaacaauuccuuuuucagccggcugaacuggcucacccaucugaaguuuaaauauccugcucuuaaugucacgaugcccaacaacgagaaguucgacaaacuguacaucuggggagugcaccauccugggacagauaaugaccagauuuuucucuaugcccaggcgucuggccgcaucaccguuuccacaaagagaagccaacagaccgugauuccgaacaucgggucccggccccgcgucagaaauauuccuucucggaucagcaucuacuggaccauugugaaacccggagauauccugcugauuaacuccacaggcaaucucaucgccccucgcggguacuucaagauuagaagcggaaagucuuccaucaugcggagcgacgcucccaucggcaaauguaacucugagugcauuacgccgaauggcagcaucccuaacgacaagcccuuucagaaugugaaccgcauuaccuauggggccuguccuagauacgucaaacagaauacacugaaacuugcuaccggaaugcggaacguucccgaaaaacaaacacgcggcaucuucggggccauugcgggauuuaucgagaauggcugggaagggaugguggauggaugguauggcuucagacaccagaacuccgagggcaucgggcaggccgcugaccugaagucuacccaagccgcuauuaaucagaucaacggaaaacucaaccggcugauuggcaagacgaaugagaaguuccaccagaucgaaaaagaguuuagcgaaguggaggggcgcauucaggaucuugaaaaguacgucgaggacacaaaaaucgaucugugguccuauaacgccgagcuccugguggcccuggaaaaucaacauaccauugaccucaccgauagcgagaugaacaagcuguucgaaagaacaaagaagcagcuucgggagaaugcugaagacaugggaaacggcugcuuuaagaucuaccacaaaugugauaaugcgugcaucgggucuauuagaaacggcaccuaugaccaugauguuuaccgcgacgaggcccugaauaaccgguuccagaucaagggaguggagcucaaauccggcuacaaggacuggauucuguggaucagcuuugcuauuucuugcuuccuucugugugucgcccuccugggguuuaucaugugggccugccagaaaggaaauaucagauguaacauuugcaucuga

SEQ ID NO: 185819 - RNA, 1701 nt, Artificial Sequence; identical to SEQ ID NO: 183654
  derived and/or modified sequence opt5 from hemagglutinin__InfluenzaA__ACR15601

SEQ ID NO: 185820 - RNA, 1701 nt, Artificial Sequence
  derived and/or modified sequence opt5 from hemagglutinin__InfluenzaA__ACR18920
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauauucaguuuaccgcuguuggaaaggaguucaaccaccuugagaagagaaucgaaaaucugaacaaaaagguggaugacggcuuccucgauauuuggacguacaaugccgagcugcugguccuccuggaaaacgagcggacacuugacuaucaugauucuaaugugaaaaaccuguacgagaagguccgcucccagcucaaaaacaaugccaaggaaaucgggaacggauguuuugaguucuaucacaagugcgacaauaccuguauggaaagcgugaaaaacggcaccuacgauuauccuaaguacucugaggaagcuaaacugaauagagaggagaucgacgggguuaaacuugaauccacacggauuuaucaaauccuggccauuuacagcaccguggcguccucucucguccuggugguuagccugggcgcuaucuccuuuuggaugugcucuaacggaagccuccagugccgcauuuguaucuga

SEQ ID NO: 185821 - RNA, 1701 nt, Artificial Sequence; identical to SEQ ID NO: 185693
  derived and/or modified sequence opt5 from hemagglutinin__InfluenzaA__ACR18975

SEQ ID NO: 185822 - RNA, 1701 nt, Artificial Sequence; identical to SEQ ID NO: 185680
  derived and/or modified sequence opt5 from hemagglutinin__InfluenzaA__ACR18976

SEQ ID NO: 185823 - RNA, 1701 nt, Artificial Sequence; identical to SEQ ID NO: 185680
  derived and/or modified sequence opt5 from hemagglutinin__InfluenzaA__ACR18977

SEQ ID NO: 185824 - RNA, 1701 nt, Artificial Sequence; identical to SEQ ID NO: 185693
  derived and/or modified sequence opt5 from hemagglutinin__InfluenzaA__ACR18978

SEQ ID NO: 185825 - RNA, 1701 nt, Artificial Sequence; identical to SEQ ID NO: 185680
  derived and/or modified sequence opt5 from hemagglutinin__InfluenzaA__ACR18979

SEQ ID NO: 185826 - RNA, 1701 nt, Artificial Sequence; identical to SEQ ID NO: 185746
  derived and/or modified sequence opt5 from hemagglutinin__InfluenzaA__ACR18981

SEQ ID NO: 185827 - RNA, 1701 nt, Artificial Sequence; identical to SEQ ID NO: 185680
  derived and/or modified sequence opt5 from hemagglutinin__InfluenzaA__ACR18982

SEQ ID NO: 185828 - RNA, 1701 nt, Artificial Sequence; identical to SEQ ID NO: 185693
  derived and/or modified sequence opt5 from hemagglutinin__InfluenzaA__ACR18988

SEQ ID NO: 185829 - RNA, 1701 nt, Artificial Sequence
  derived and/or modified sequence opt5 from hemagglutinin__InfluenzaA__ACR18991
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaauagaaaacuuuguaagcugcgcgggguugcuccccuccaucugggaaaaugcaacaucgccggcuggauucuggggaauccugagugugaaucucucagcacagccuccucuuggagcuacaucguggagaccuccucuagcgacaacggaacgugcuauccgggcgauuuuauugacuacgaggagcugcgggagcagcuuuccagcgucucuuccuucgaaagauuugagaucuuccccaagaccagcucuuggccuaaucacgauuccaacaagggggugacagccgcuuguccccaugccggagcgaaaucuuuuuauaagaaucugaucuggcucguuaaaaagggcaacagcuacccuaaacuguccaagagcuauauuaaugacaagggcaaagaagugcuuguccugugggggauccaccaccccuccaccucugccgaucaacagagccucuaccagaacgcugacgccuacguguucgugggauccagccgguauucuaagaaauuuaagccugagauugcuauccgcccgaaagucagagaucaggagggccggaugaauuacuauuggacacugguugaacccggggacaagauuaccuucgaggccacgggaaaccugguggugccucgcuacgcguuugccauggaaagaaacgcuggcuccgggaucauuaucagcgauacacccguccaugacugcaauaccacaugucaaaccccuaaaggagccaucaacaccucucuccccuuccagaauauucacccgaucacaauuggcaagugcccuaaguaugugaaaagcacgaagcugcggcuugcuaccggccugcgcaacguucccuccauccagucuagagggcucuuuggagccauugccggcuucaucgaagggggauggacaggcaugguggacgggugguacggauaucaucaccagaaugaacaaggcagcggcuacgcugcggaucugaaauccacccagaacgccaucgacgagauuacaaauaaggucaacagcgugaucgagaaaaugaauacccaguuuacggcuguugggaaggaguucaaccaccuugaaaagcggauugaaaaucugaacaaaaagguggaugacggauuccucgauaucuggacauacaaugccgagcugcugguccuccuggaaaacgagcgcacccuugacuaucaugauucuaaugugaaaaaccuguacgagaaggucagaucccagcucaaaaacaaugccaaggaaauuggcaacggguguuuugaguucuaucacaagugcgacaauaccuguauggaaagcgugaaaaacggaacauacgauuauccuaaguacucugaggaagcuaaacugaaucgggaggagaucgacggcguuaaacuugaauccacccgcaucuaucaaauucuggccaucuacagcacaguggcguccucucucguccuggugguuagccugggggcuauuuccuuuuggaugugcucuaacggcagccuccagugcagaaucuguauuuga

SEQ ID NO: 185830 - RNA, 1701 nt, Artificial Sequence; identical to SEQ ID NO: 185680
  derived and/or modified sequence opt5 from hemagglutinin__InfluenzaA__ACR18993

SEQ ID NO: 185831 - RNA, 1701 nt, Artificial Sequence; identical to SEQ ID NO: 185719
  derived and/or modified sequence opt5 from hemagglutinin__InfluenzaA__ACR18995

SEQ ID NO: 185832 - RNA, 1701 nt, Artificial Sequence; identical to SEQ ID NO: 185741
  derived and/or modified sequence opt5 from hemagglutinin__InfluenzaA__ACR23302

SEQ ID NO: 185833 - RNA, 1701 nt, Artificial Sequence; identical to SEQ ID NO: 185693
  derived and/or modified sequence opt5 from hemagglutinin__InfluenzaA__ACR33743

SEQ ID NO: 185834 - RNA, 1701 nt, Artificial Sequence; identical to SEQ ID NO: 185680
  derived and/or modified sequence opt5 from hemagglutinin__InfluenzaA__ACR38821

SEQ ID NO: 185835 - RNA, 1701 nt, Artificial Sequence; identical to SEQ ID NO: 185680
  derived and/or modified sequence opt5 from hemagglutinin__InfluenzaA__ACR38822

SEQ ID NO: 185836 - RNA, 1701 nt, Artificial Sequence; identical to SEQ ID NO: 185680
  derived and/or modified sequence opt5 from hemagglutinin__InfluenzaA__ACR38823

SEQ ID NO: 185837 - RNA, 1701 nt, Artificial Sequence; identical to SEQ ID NO: 185746
  derived and/or modified sequence opt5 from hemagglutinin__InfluenzaA__ACR38824

SEQ ID NO: 185838 - RNA, 1701 nt, Artificial Sequence
  derived and/or modified sequence opt5 from hemagglutinin__InfluenzaA__ACR38825
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagaucgacgauggguuccucgacauuuggaccuacaaugccgagcugcuggugcuccuggaaaacgagcggacccuugauuaucaugacagcaaugucaaaaaccuguacgagaaggugcgcucucagcucaaaaacaaugccaaggaaaucggaaacggcuguuuugaguucuaucacaagugcgauaauacauguauggaauccgucaaaaacgggaccuacgacuauccuaaguacagcgaggaagcuaaacugaauagagaggagaucgauggcgugaaacuugaaucuacacggauuuaucaaauccuggccauuuacuccacgguugcgagcucccucgugcuggucgugucucugggagcuaucagcuuuuggaugugcuccaacggcucucuccagugccgcauuuguaucuga

SEQ ID NO: 185839 - RNA, 1701 nt, Artificial Sequence; identical to SEQ ID NO: 185693
  derived and/or modified sequence opt5 from hemagglutinin__InfluenzaA__ACR38826

SEQ ID NO: 185840 - RNA, 1701 nt, Artificial Sequence; identical to SEQ ID NO: 185680
  derived and/or modified sequence opt5 from hemagglutinin__InfluenzaA__ACR38827

SEQ ID NO: 185841 - RNA, 1701 nt, Artificial Sequence; identical to SEQ ID NO: 185746
  derived and/or modified sequence opt5 from hemagglutinin__InfluenzaA__ACR38828

SEQ ID NO: 185842 - RNA, 1701 nt, Artificial Sequence; identical to SEQ ID NO: 185680
  derived and/or modified sequence opt5 from hemagglutinin__InfluenzaA__ACR38829

SEQ ID NO: 185843 - RNA, 1701 nt, Artificial Sequence; identical to SEQ ID NO: 185719
  derived and/or modified sequence opt5 from hemagglutinin__InfluenzaA__ACR38830

SEQ ID NO: 185844 - RNA, 1701 nt, Artificial Sequence; identical to SEQ ID NO: 185693
  derived and/or modified sequence opt5 from hemagglutinin__InfluenzaA__ACR39354

SEQ ID NO: 185845 - RNA, 1701 nt, Artificial Sequence; identical to SEQ ID NO: 185693
  derived and/or modified sequence opt5 from hemagglutinin__InfluenzaA__ACR39393

SEQ ID NO: 185846 - RNA, 1701 nt, Artificial Sequence; identical to SEQ ID NO: 185693
  derived and/or modified sequence opt5 from hemagglutinin__InfluenzaA__ACR39403

SEQ ID NO: 185847 - RNA, 1701 nt, Artificial Sequence; identical to SEQ ID NO: 185693
  derived and/or modified sequence opt5 from hemagglutinin__InfluenzaA__ACR39413

SEQ ID NO: 185848 - RNA, 1701 nt, Artificial Sequence; identical to SEQ ID NO: 185693
  derived and/or modified sequence opt5 from hemagglutinin__InfluenzaA__ACR39423

SEQ ID NO: 185849 - RNA, 1701 nt, Artificial Sequence; identical to SEQ ID NO: 185693
  derived and/or modified sequence opt5 from hemagglutinin__InfluenzaA__ACR39433

SEQ ID NO: 185850 - RNA, 1701 nt, Artificial Sequence; identical to SEQ ID NO: 185693
  derived and/or modified sequence opt5 from hemagglutinin__InfluenzaA__ACR39443

SEQ ID NO: 185851 - RNA, 1701 nt, Artificial Sequence
  derived and/or modified sequence opt5 from hemagglutinin__InfluenzaA__ACR39453
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgaucaggaagggagaaugaauuacuauuggacccugguugagcccggagacaaaauuacguucgaagccacaggcaaccugguggugccucgguacgcguuugccauggagcgcaacgcugggucuggaaucauuaucuccgauacccccguccaugacugcaauacaaccugucaaaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuugaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaauccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 185852 - RNA, 1701 nt, Artificial Sequence; identical to SEQ ID NO: 185693
  derived and/or modified sequence opt5 from hemagglutinin__InfluenzaA__ACR39463

SEQ ID NO: 185853 - RNA, 1701 nt, Artificial Sequence; identical to SEQ ID NO: 185693
  derived and/or modified sequence opt5 from hemagglutinin__InfluenzaA__ACR39473

SEQ ID NO: 185854 - RNA, 1701 nt, Artificial Sequence; identical to SEQ ID NO: 185693
  derived and/or modified sequence opt5 from hemagglutinin__InfluenzaA__ACR39483

SEQ ID NO: 185855 - RNA, 1701 nt, Artificial Sequence; identical to SEQ ID NO: 185693
  derived and/or modified sequence opt5 from hemagglutinin__InfluenzaA__ACR39493

SEQ ID NO: 185856 - RNA, 1701 nt, Artificial Sequence; identical to SEQ ID NO: 185693
  derived and/or modified sequence opt5 from hemagglutinin__InfluenzaA__ACR40288

SEQ ID NO: 185857 - RNA, 1701 nt, Artificial Sequence; identical to SEQ ID NO: 185693
  derived and/or modified sequence opt5 from hemagglutinin__InfluenzaA__ACR40298

SEQ ID NO: 185858 - RNA, 1701 nt, Artificial Sequence
  derived and/or modified sequence opt5 from hemagglutinin__InfluenzaA__ACR40308
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauuuauccgaucacaauuggcaagugcccuaaguacgugaaaagcacgaagcugagacuugcuaccgggcugcggaacguucccuccauccagucucgcggacucuuuggcgccauugccggguucaucgagggaggcuggacagggaugguggacggaugguauggcuaccaccaucagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauauaaugccgagcugcugguccuccuggaaaacgagcggacccuugacuaccacgauucuaaugugaaaaaccuguaugagaagguccgcucccagcucaaaaacaaugccaaggaaauugggaacggauguuuugaguucuaccauaagugcgacaauaccuguauggaaagcgugaaaaacggcacauaugauuacccuaaguauucugaggaagcuaaacugaauagagaggagaucgacgggguuaaacuugaauccacccggaucuaccaaauucuggccaucuacagcacaguggcguccucucucguccuggugguuagccugggcgcuauuuccuuuuggaugugcucuaacggaagccuccagugccgcaucuguauuuga

SEQ ID NO: 185859 - RNA, 1701 nt, Artificial Sequence; identical to SEQ ID NO: 185693
  derived and/or modified sequence opt5 from hemagglutinin__InfluenzaA__ACR40318

SEQ ID NO: 185860 - RNA, 1701 nt, Artificial Sequence; identical to SEQ ID NO: 185693
  derived and/or modified sequence opt5 from hemagglutinin__InfluenzaA__ACR40328

SEQ ID NO: 185861 - RNA, 1701 nt, Artificial Sequence; identical to SEQ ID NO: 185693
  derived and/or modified sequence opt5 from hemagglutinin__InfluenzaA__ACR40338

SEQ ID NO: 185862 - RNA, 1701 nt, Artificial Sequence; identical to SEQ ID NO: 185693
  derived and/or modified sequence opt5 from hemagglutinin__InfluenzaA__ACR40348

SEQ ID NO: 185863 - RNA, 1701 nt, Artificial Sequence; identical to SEQ ID NO: 185693
  derived and/or modified sequence opt5 from hemagglutinin__InfluenzaA__ACR40358

SEQ ID NO: 185864 - RNA, 1701 nt, Artificial Sequence; identical to SEQ ID NO: 185693
  derived and/or modified sequence opt5 from hemagglutinin__InfluenzaA__ACR40378

SEQ ID NO: 185865 - RNA, 1701 nt, Artificial Sequence; identical to SEQ ID NO: 185693
  derived and/or modified sequence opt5 from hemagglutinin__InfluenzaA__ACR40388

SEQ ID NO: 185866 - RNA, 1701 nt, Artificial Sequence; identical to SEQ ID NO: 185680
  derived and/or modified sequence opt5 from hemagglutinin__InfluenzaA__ACR46986

SEQ ID NO: 185867 - RNA, 1701 nt, Artificial Sequence; identical to SEQ ID NO: 185680
  derived and/or modified sequence opt5 from hemagglutinin__InfluenzaA__ACR46988

SEQ ID NO: 185868 - RNA, 1701 nt, Artificial Sequence; identical to SEQ ID NO: 185680
  derived and/or modified sequence opt5 from hemagglutinin__InfluenzaA__ACR46989

SEQ ID NO: 185869 - RNA, 1701 nt, Artificial Sequence; identical to SEQ ID NO: 185680
  derived and/or modified sequence opt5 from hemagglutinin__InfluenzaA__ACR46990

SEQ ID NO: 185870 - RNA, 1701 nt, Artificial Sequence; identical to SEQ ID NO: 185680
  derived and/or modified sequence opt5 from hemagglutinin__InfluenzaA__ACR46992

SEQ ID NO: 185871 - RNA, 1701 nt, Artificial Sequence; identical to SEQ ID NO: 185680
  derived and/or modified sequence opt5 from hemagglutinin__InfluenzaA__ACR46993

SEQ ID NO: 185872 - RNA, 1701 nt, Artificial Sequence; identical to SEQ ID NO: 185680
  derived and/or modified sequence opt5 from hemagglutinin__InfluenzaA__ACR46994

SEQ ID NO: 185873 - RNA, 1701 nt, Artificial Sequence
  derived and/or modified sequence opt5 from hemagglutinin__InfluenzaA__ACR47006
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaaucgggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 185874 - RNA, 1701 nt, Artificial Sequence; identical to SEQ ID NO: 185693
  derived and/or modified sequence opt5 from hemagglutinin__InfluenzaA__ACR49281

SEQ ID NO: 185875 - RNA, 1701 nt, Artificial Sequence
  derived and/or modified sequence opt5 from hemagglutinin__InfluenzaA__ACR49282
augaaggccauccuggugguccuccuguacaccuucgcuacagccaacgcggacacgcuuugcauuggcuaucacgcuaauaacagcaccgauacaguugacaccgugcuggagaagaaugugacagucacccauuccguggaucuccuggaagacaagcacaacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcuccagcagauauucuaagaaauuuaagccugagauugcuauccggccgaaaguccgcgaccaggaggggagaaugaacuacuauuggacacugguugaacccggagauaagauuaccuucgaggccacgggcaaucugguggugccucgguacgcguuugccauggaacgcaacgcuggguccggaaucauuaucagcgacacacccguccaugacugcaacaccacaugucaaaccccuaaaggcgccaucaauaccucucuccccuuccagaacauucacccgaucacaauuggcaagugcccuaaguaugugaaaagcacgaagcugagacuugcuaccgggcugcggaauguucccuccauccagucucgcggacucuuuggcgccauugccggguucaucgagggaggcuggacagggaugguggauggaugguacggcuaucaucaccagaacgaacaaggcagcggguacgcugcggaccugaaauccacccagaaugccaucgaugagauuacaaacaaggucaauagcgugaucgagaaaaugaacacccaguuuacggcuguuggaaaggaguucaaucaccuugagaagagaauugaaaaccugaauaaaaagguggacgauggcuuccucgacaucuggacauacaacgccgagcugcugguccuccuggaaaaugagcggacccuugauuaucaugacucuaacgugaaaaaucuguacgagaagguccgcucccagcucaaaaacaacgccaaggaaauugggaauggauguuuugaguucuaucacaagugcgauaacaccuguauggaaagcgugaaaaauggcacauacgacuauccuaaguacucugaggaagcuaaacugaacagagaggagaucgaugggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 185876 - RNA, 1701 nt, Artificial Sequence; identical to SEQ ID NO: 185680
  derived and/or modified sequence opt5 from hemagglutinin__InfluenzaA__ACR49283

SEQ ID NO: 185877 - RNA, 1701 nt, Artificial Sequence; identical to SEQ ID NO: 185680
  derived and/or modified sequence opt5 from hemagglutinin__InfluenzaA__ACR49288

SEQ ID NO: 185878 - RNA, 1701 nt, Artificial Sequence; identical to SEQ ID NO: 185719
  derived and/or modified sequence opt5 from hemagglutinin__InfluenzaA__ACR49290

SEQ ID NO: 185879 - RNA, 1701 nt, Artificial Sequence; identical to SEQ ID NO: 185693
  derived and/or modified sequence opt5 from hemagglutinin__InfluenzaA__ACR49291

SEQ ID NO: 185880 - RNA, 1701 nt, Artificial Sequence; identical to SEQ ID NO: 185719
  derived and/or modified sequence opt5 from hemagglutinin__InfluenzaA__ACR49293

SEQ ID NO: 185881 - RNA, 1701 nt, Artificial Sequence; identical to SEQ ID NO: 185719
  derived and/or modified sequence opt5 from hemagglutinin__InfluenzaA__ACR49295

SEQ ID NO: 185882 - RNA, 1701 nt, Artificial Sequence; identical to SEQ ID NO: 185733
  derived and/or modified sequence opt5 from hemagglutinin__InfluenzaA__ACR50993

SEQ ID NO: 185883 - RNA, 1701 nt, Artificial Sequence; identical to SEQ ID NO: 185693
  derived and/or modified sequence opt5 from hemagglutinin__InfluenzaA__ACR50995

SEQ ID NO: 185884 - RNA, 1701 nt, Artificial Sequence; identical to SEQ ID NO: 185693
  derived and/or modified sequence opt5 from hemagglutinin__InfluenzaA__ACR51005

SEQ ID NO: 185885 - RNA, 1701 nt, Artificial Sequence; identical to SEQ ID NO: 185693
  derived and/or modified sequence opt5 from hemagglutinin__InfluenzaA__ACR51015

SEQ ID NO: 185886 - RNA, 1701 nt, Artificial Sequence; identical to SEQ ID NO: 185693
  derived and/or modified sequence opt5 from hemagglutinin__InfluenzaA__ACR51025

SEQ ID NO: 185887 - RNA, 1701 nt, Artificial Sequence; identical to SEQ ID NO: 185693
  derived and/or modified sequence opt5 from hemagglutinin__InfluenzaA__ACR51035

SEQ ID NO: 185888 - RNA, 1701 nt, Artificial Sequence; identical to SEQ ID NO: 185693
  derived and/or modified sequence opt5 from hemagglutinin__InfluenzaA__ACR51045

SEQ ID NO: 185889 - RNA, 1701 nt, Artificial Sequence; identical to SEQ ID NO: 185693
  derived and/or modified sequence opt5 from hemagglutinin__InfluenzaA__ACR51055

SEQ ID NO: 185890 - RNA, 1701 nt, Artificial Sequence; identical to SEQ ID NO: 185680
  derived and/or modified sequence opt5 from hemagglutinin__InfluenzaA__ACR51065

SEQ ID NO: 185891 - RNA, 1701 nt, Artificial Sequence; identical to SEQ ID NO: 185693
  derived and/or modified sequence opt5 from hemagglutinin__InfluenzaA__ACR52368

SEQ ID NO: 185892 - RNA, 1701 nt, Artificial Sequence; identical to SEQ ID NO: 185693
  derived and/or modified sequence opt5 from hemagglutinin__InfluenzaA__ACR52378

SEQ ID NO: 185893 - RNA, 1701 nt, Artificial Sequence; identical to SEQ ID NO: 185693
  derived and/or modified sequence opt5 from hemagglutinin__InfluenzaA__ACR52398

SEQ ID NO: 185894 - RNA, 1701 nt, Artificial Sequence; identical to SEQ ID NO: 185693
  derived and/or modified sequence opt5 from hemagglutinin__InfluenzaA__ACR52408

SEQ ID NO: 185895 - RNA, 1701 nt, Artificial Sequence; identical to SEQ ID NO: 185693
  derived and/or modified sequence opt5 from hemagglutinin__InfluenzaA__ACR52418

SEQ ID NO: 185896 - RNA, 1701 nt, Artificial Sequence; identical to SEQ ID NO: 185693
  derived and/or modified sequence opt5 from hemagglutinin__InfluenzaA__ACR52428

SEQ ID NO: 185897 - RNA, 1701 nt, Artificial Sequence; identical to SEQ ID NO: 185693
  derived and/or modified sequence opt5 from hemagglutinin__InfluenzaA__ACR52438

SEQ ID NO: 185898 - RNA, 1701 nt, Artificial Sequence; identical to SEQ ID NO: 185693
  derived and/or modified sequence opt5 from hemagglutinin__InfluenzaA__ACR52448

SEQ ID NO: 185899 - RNA, 1701 nt, Artificial Sequence; identical to SEQ ID NO: 185693
  derived and/or modified sequence opt5 from hemagglutinin__InfluenzaA__ACR52458

SEQ ID NO: 185900 - RNA, 1701 nt, Artificial Sequence; identical to SEQ ID NO: 185693
  derived and/or modified sequence opt5 from hemagglutinin__InfluenzaA__ACR52468

SEQ ID NO: 185901 - RNA, 1701 nt, Artificial Sequence; identical to SEQ ID NO: 185693
  derived and/or modified sequence opt5 from hemagglutinin__InfluenzaA__ACR52478

SEQ ID NO: 185902 - RNA, 1701 nt, Artificial Sequence; identical to SEQ ID NO: 185693
  derived and/or modified sequence opt5 from hemagglutinin__InfluenzaA__ACR52488

SEQ ID NO: 185903 - RNA, 1701 nt, Artificial Sequence; identical to SEQ ID NO: 185693
  derived and/or modified sequence opt5 from hemagglutinin__InfluenzaA__ACR54045

SEQ ID NO: 185904 - RNA, 1701 nt, Artificial Sequence
  derived and/or modified sequence opt5 from hemagglutinin__InfluenzaA__ACR54047
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggaucaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 185905 - RNA, 1701 nt, Artificial Sequence
  derived and/or modified sequence opt5 from hemagglutinin__InfluenzaA__ACR54964
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuauugcuguuggaaaggaguucaaccaccuugagaagagaaucgaaaaucugaacaaaaagguggaugacggcuuccucgauauuuggacauacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagaucgacgggguuaaacuugaaucuacccggauuuaucaaauccuggccauuuacuccacaguggcgagcucccucguccuggugguuucucugggcgcuaucagcuuuuggaugugcuccaacggaucucuccagugccgcauuuguaucuga

SEQ ID NO: 185906 - RNA, 1701 nt, Artificial Sequence; identical to SEQ ID NO: 185784
  derived and/or modified sequence opt5 from hemagglutinin__InfluenzaA__ACR54974

SEQ ID NO: 185907 - RNA, 1701 nt, Artificial Sequence; identical to SEQ ID NO: 185693
  derived and/or modified sequence opt5 from hemagglutinin__InfluenzaA__ACR54984

SEQ ID NO: 185908 - RNA, 1701 nt, Artificial Sequence; identical to SEQ ID NO: 185680
  derived and/or modified sequence opt5 from hemagglutinin__InfluenzaA__ACR54994

SEQ ID NO: 185909 - RNA, 1701 nt, Artificial Sequence; identical to SEQ ID NO: 185680
  derived and/or modified sequence opt5 from hemagglutinin__InfluenzaA__ACR55004

SEQ ID NO: 185910 - RNA, 1701 nt, Artificial Sequence; identical to SEQ ID NO: 185873
  derived and/or modified sequence opt5 from hemagglutinin__InfluenzaA__ACR56380

SEQ ID NO: 185911 - RNA, 1701 nt, Artificial Sequence; identical to SEQ ID NO: 185746
  derived and/or modified sequence opt5 from hemagglutinin__InfluenzaA__ACR56390

SEQ ID NO: 185912 - RNA, 1701 nt, Artificial Sequence; identical to SEQ ID NO: 185693
  derived and/or modified sequence opt5 from hemagglutinin__InfluenzaA__ACR56400

SEQ ID NO: 185913 - RNA, 1701 nt, Artificial Sequence; identical to SEQ ID NO: 185693
  derived and/or modified sequence opt5 from hemagglutinin__InfluenzaA__ACR56410

SEQ ID NO: 185914 - RNA, 1701 nt, Artificial Sequence; identical to SEQ ID NO: 185693
  derived and/or modified sequence opt5 from hemagglutinin__InfluenzaA__ACR56420

SEQ ID NO: 185915 - RNA, 1701 nt, Artificial Sequence; identical to SEQ ID NO: 185693
  derived and/or modified sequence opt5 from hemagglutinin__InfluenzaA__ACR56430

SEQ ID NO: 185916 - RNA, 1701 nt, Artificial Sequence; identical to SEQ ID NO: 185693
  derived and/or modified sequence opt5 from hemagglutinin__InfluenzaA__ACR56440

SEQ ID NO: 185917 - RNA, 1698 nt, Artificial Sequence
  derived and/or modified sequence opt5 from hemagglutinin__InfluenzaA__ACR58541
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaagaaagaauggccucuaccccaaccugucuaaguccuaugcuaauaacaaagagaaggaagugcugguccucuggggagugcaccacccuccgaacaucggggaccagaaagcccuguaccauaccgagaaugcuuacgugagcgucguuuccucucacuauagccggaaguucacacccgaaauugccaagcgcccuaaagugagagaucaggagggccggaucaacuacuauuggacccuucuggagcccggggacacgauuaucuuugaagcgaauggaaaccucauugccccucgcuacgcuuucgcccuguccagaggcuuugggagcggaaucauuaauucuaacgcucccauggauaagugugacgccaaaugccagacaccgcaaggcgcgaucaauuccagccuuccuuuccagaacgugcaucccgucaccaucggcgaguguccuaaguaugugcggucugccaaacugcgcaugguuacagggcucagaaauauucccagcauccagucccggggacuguuuggcgcuauugccggguucaucgaaggaggcuggaccgggaugguggauggaugguacggcuaucaccaccagaacgagcaaggcucuggguacgcugccgaccagaaaagcacccagaaugccauuaacggaaucacaaauaaagucaacuccgugaucgauaagaugaauacgcaguuuaccgcuguuggcaaggaguucaacaaacuggaacgcagaauggagaaccucaauaagaaaguggacgauggguucauugacaucuggacauacaacgcggaacugcuuguccugcucgagaaugaacggacccuggacuuucaugauagcaacgugaagaaucuuuaugagaaagucaagucucaacugaagaacaaugccaaagaaauuggaaacggcugcuucgaguuuuaccacaaguguaaugacgagugcauggaauccgugaaaaacgggacauaugauuaccccaaguauagcgaggaaucuaaacucaaucgcgagaagaucgacggcguuaagcuggaguccaugggaguguaccagauucuggcuaucuauagcaccgucgccuccucucucgugcugcuuguuagccugggcgccaucuccuucuggaugugcucuaacgggagccuccaguguagaauuugcaucuga

SEQ ID NO: 185918 - RNA, 1698 nt, Artificial Sequence; identical to SEQ ID NO: 184938
  derived and/or modified sequence opt5 from hemagglutinin__InfluenzaA__ACR61655

SEQ ID NO: 185919 - RNA, 1698 nt, Artificial Sequence; identical to SEQ ID NO: 184954
  derived and/or modified sequence opt5 from hemagglutinin__InfluenzaA__ACR61666

SEQ ID NO: 185920 - RNA, 1701 nt, Artificial Sequence; identical to SEQ ID NO: 185458
  derived and/or modified sequence opt5 from hemagglutinin__InfluenzaA__ACR61677

SEQ ID NO: 185921 - RNA, 1701 nt, Artificial Sequence; identical to SEQ ID NO: 185458
  derived and/or modified sequence opt5 from hemagglutinin__InfluenzaA__ACR61688

SEQ ID NO: 185922 - RNA, 1701 nt, Artificial Sequence; identical to SEQ ID NO: 185458
  derived and/or modified sequence opt5 from hemagglutinin__InfluenzaA__ACR61699

SEQ ID NO: 185923 - RNA, 1701 nt, Artificial Sequence; identical to SEQ ID NO: 185680
  derived and/or modified sequence opt5 from hemagglutinin__InfluenzaA__ACR67170

SEQ ID NO: 185924 - RNA, 1701 nt, Artificial Sequence; identical to SEQ ID NO: 185719
  derived and/or modified sequence opt5 from hemagglutinin__InfluenzaA__ACR67171

SEQ ID NO: 185925 - RNA, 1701 nt, Artificial Sequence; identical to SEQ ID NO: 185680
  derived and/or modified sequence opt5 from hemagglutinin__InfluenzaA__ACR67172

SEQ ID NO: 185926 - RNA, 1701 nt, Artificial Sequence; identical to SEQ ID NO: 185680
  derived and/or modified sequence opt5 from hemagglutinin__InfluenzaA__ACR67177

SEQ ID NO: 185927 - RNA, 1701 nt, Artificial Sequence; identical to SEQ ID NO: 185680
  derived and/or modified sequence opt5 from hemagglutinin__InfluenzaA__ACR67181

SEQ ID NO: 185928 - RNA, 1701 nt, Artificial Sequence
  derived and/or modified sequence opt5 from hemagglutinin__InfluenzaA__ACR67183
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgauagagaggggcggaugaauuacuauuggacacugguugaacccggagacaagauuaccuucgaggccacgggcaaccugguggugccucgcuacgcguuugccauggaaagaaacgcuggguccggaaucauuaucagcgauacacccguccaugacugcaauaccacaugucagaccccuaaaggcgccaucaacaccucucuccccuuccaaaauauucacccgaucacaauuggcaagugcccuaaguaugugaaaagcacgaagcugcggcuugcuaccgggcugcgcaacguucccuccauccagucuagaggacucuuuggcgccauugccggguucaucgagggaggcuggacagggaugguggacggaugguacggcuaucaucaccagaaugaacagggcagcggguacgcugcggaucugaaauccacccaaaacgccaucgacgagauuacaaauaaggucaacagcgugaucgagaaaaugaauacccaguuuacggcuguuggaaaggaguucaaccaccuugagaagcggauugaaaaucugaacaaaaagguggaugacggcuuccucgauaucuggacauacaaugccgagcugcugguccuccuggaaaacgagcgcacccuugacuaucaugauucuaaugugaaaaaccuguacgagaaggucagaucccagcucaaaaacaaugccaaggaaauugggaacggauguuuugaguucuaucacaagugcgacaauaccuguauggaaagcgugaaaaacggcacauacgauuauccuaaguacucugaggaagcuaaacugaaucgggaggagaucgacgggguuaaacuugaauccacccgcaucuaucagauucuggccaucuacagcacaguggcguccucucucguccuggugguuagccugggcgcuauuuccuuuuggaugugcucuaacggaagccuccaaugcagaaucuguauuuga

SEQ ID NO: 185929 - RNA, 1701 nt, Artificial Sequence; identical to SEQ ID NO: 185693
  derived and/or modified sequence opt5 from hemagglutinin__InfluenzaA__ACR67184

SEQ ID NO: 185930 - RNA, 1701 nt, Artificial Sequence; identical to SEQ ID NO: 185680
  derived and/or modified sequence opt5 from hemagglutinin__InfluenzaA__ACR67185

SEQ ID NO: 185931 - RNA, 1701 nt, Artificial Sequence; identical to SEQ ID NO: 185873
  derived and/or modified sequence opt5 from hemagglutinin__InfluenzaA__ACR67186

SEQ ID NO: 185932 - RNA, 1701 nt, Artificial Sequence; identical to SEQ ID NO: 185680
  derived and/or modified sequence opt5 from hemagglutinin__InfluenzaA__ACR67187

SEQ ID NO: 185933 - RNA, 1701 nt, Artificial Sequence; identical to SEQ ID NO: 185719
  derived and/or modified sequence opt5 from hemagglutinin__InfluenzaA__ACR67188

SEQ ID NO: 185934 - RNA, 1701 nt, Artificial Sequence; identical to SEQ ID NO: 185719
  derived and/or modified sequence opt5 from hemagglutinin__InfluenzaA__ACR67189

SEQ ID NO: 185935 - RNA, 1701 nt, Artificial Sequence
  derived and/or modified sequence opt5 from hemagglutinin__InfluenzaA__ACR67190
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuauccuaaauacucugaagaggcuaagcugaauagagaggaaaucgacgggguuaaacuugaguccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 185936 - RNA, 1701 nt, Artificial Sequence; identical to SEQ ID NO: 185680
  derived and/or modified sequence opt5 from hemagglutinin__InfluenzaA__ACR67192

SEQ ID NO: 185937 - RNA, 1701 nt, Artificial Sequence
  derived and/or modified sequence opt5 from hemagglutinin__InfluenzaA__ACR67193
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaaaugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugagugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgaaggaggcuggacagggaugguggacggaugguacggcuaucaucaccagaaugagcaaggcagcggguacgcugcggaccucaaauccacccagaacgccauugaugagaucacaaauaaggucaacagcgugauugaaaagaugaauacccaguuuacggcuguuggaaaggaguucaaccaccuggaaaagagaaucgagaaucuuaacaaaaagguggacgauggcuuccuggacauuuggacauacaaugccgaacuccugguccugcucgagaacgagcggacccuggauuaucaugacucuaaugugaaaaaccuuuacgaaaagguccgcucccagcugaaaaacaaugccaaggagaucgggaacggauguuuugaguucuaucacaagugcgauaauaccuguauggagagcgugaaaaacggcacauacgacuauccuaaguacucugaagaggcuaaacucaauagagaggaaaucgaugggguuaagcuggaguccacccggauuuaucaaauccuugccauuuacagcacaguggcguccucucugguccucgugguuagccugggcgcuaucuccuuuuggaugugcucuaacggaagccugcagugccgcauuuguaucuga

SEQ ID NO: 185938 - RNA, 1701 nt, Artificial Sequence; identical to SEQ ID NO: 185680
  derived and/or modified sequence opt5 from hemagglutinin__InfluenzaA__ACR67195

SEQ ID NO: 185939 - RNA, 1701 nt, Artificial Sequence; identical to SEQ ID NO: 185680
  derived and/or modified sequence opt5 from hemagglutinin__InfluenzaA__ACR67197

SEQ ID NO: 185940 - RNA, 1701 nt, Artificial Sequence; identical to SEQ ID NO: 185937
  derived and/or modified sequence opt5 from hemagglutinin__InfluenzaA__ACR67198

SEQ ID NO: 185941 - RNA, 1701 nt, Artificial Sequence; identical to SEQ ID NO: 185680
  derived and/or modified sequence opt5 from hemagglutinin__InfluenzaA__ACR67199

SEQ ID NO: 185942 - RNA, 1701 nt, Artificial Sequence; identical to SEQ ID NO: 185693
  derived and/or modified sequence opt5 from hemagglutinin__InfluenzaA__ACR67244

SEQ ID NO: 185943 - RNA, 1701 nt, Artificial Sequence
  derived and/or modified sequence opt5 from hemagglutinin__InfluenzaA__ACR67254
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgucggguccggaaucauuaucagcgauacacccgugcaugacugcaauaccacaugucaaaccccuaaaggcgcuaucaacaccucucuccccuuccagaauauucacccgaucacaauuggcaagugcccuaaguauguuaaaagcacgaagcugagacuugccaccgggcugcggaacgugcccuccauccagucucgcggacucuuuggcgcuauugccggguucaucgagggaggcuggacagggauggucgacggaugguacggcuaucaucaccagaaugaacaaggcagcggguacgccgcugaucugaaauccacccagaacgcgaucgacgagauuacaaauaaggugaacagcguuaucgagaaaaugaauacccaguuuacggccgugggaaaggaguucaaccaccuugagaagagaauugaaaaucugaacaaaaaggucgaugacggcuuccucgauaucuggacauacaaugcugagcugcuggugcuccuggaaaacgagcggacccuugacuaucaugauucuaaugucaaaaaccuguacgagaaggugcgcucccagcucaaaaacaaugccaaggaaauugggaacggauguuuugaguucuaucacaagugcgacaauaccuguauggaaagcguuaaaaacggcacauacgauuauccuaaguacucugaggaagccaaacugaauagagaggagaucgacggggugaaacuugaauccacccggaucuaucaaauucuggcuaucuacagcacagucgccuccucucucgugcugguugugagccugggcgcgauuuccuuuuggaugugcucuaacggaagccuccagugccgcaucuguauuuga

SEQ ID NO: 185944 - RNA, 1701 nt, Artificial Sequence; identical to SEQ ID NO: 185693
  derived and/or modified sequence opt5 from hemagglutinin__InfluenzaA__ACR77438

SEQ ID NO: 185945 - RNA, 1701 nt, Artificial Sequence; identical to SEQ ID NO: 185693
  derived and/or modified sequence opt5 from hemagglutinin__InfluenzaA__ACR77448

SEQ ID NO: 185946 - RNA, 1701 nt, Artificial Sequence
  derived and/or modified sequence opt5 from hemagglutinin__InfluenzaA__ACR77458
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucuggacaaaugcaacaucgccggcuggauucuggggaauccugagugugaaucucucagcacagccuccucuuggagcuacaucguggagaccuccucuagcgauaacggaacgugcuauccgggcgacuuuauugauuacgaggagcugcgggagcagcuuuccagcgucucuuccuucgaacgcuuugagaucuuccccaagaccagcucuuggccuaaucacgacuccaacaagggggugacagccgcuuguccccaugccggagcgaaaucuuuuuauaagaaucugaucuggcucguuaaaaagggcaacagcuacccuaaacuguccaagagcuauauuaaugauaagggcaaagaagugcuuguccugugggggauccaccaccccuccaccucugccgaccaacagagccucuaccagaacgcugaugccuacguguucgugggaacauccagauauagcaagaaauuuaagccugagauugcuauccggccgaaaguccgcgaccaggagggcagaaugaauuacuauuggacccugguugaacccggggauaagauuacguucgaggccacaggaaaccugguggugccucgguacgcguuugccauggaacgcaacgcuggcucugggaucauuaucuccgacacccccguccaugacugcaauacaaccugucaaaccccuaaaggagccaucaacacaagccuccccuuccagaauauucacccgaucacgauuggcaagugcccuaaguaugugaaaucuaccaagcugagacuugcuacaggccugcggaacguucccagcauccagucccgcgggcucuuuggagccauugccggcuucaucgaagggggauggaccggcaugguggaugggugguacggauaucaucaccagaaugaacaaggcucuggcuacgcugcggaccugaaaagcacacagaacgccaucgaugagauuaccaauaaggucaacuccgugaucgagaaaaugaauacgcaguuuacagcuguugggaaggaguucaaccaccuugaaaagagaauugaaaaucugaacaaaaagguggacgauggauuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggcaacggguguuuugaguucuaucacaagugcgauaauacauguauggaauccgugaaaaacggaaccuacgacuauccuaaguacagcgaggaagcuaaacugaauagagaggagaucgauggcguuaaacuugaaucuacacggaucuaucaaauucuggccaucuacuccacgguggcgagcucccucguccuggugguuucucugggggcuauuagcuuuuggaugugcuccaacggcucucuccagugccgcaucuguauuuga

SEQ ID NO: 185947 - RNA, 1701 nt, Artificial Sequence; identical to SEQ ID NO: 185693
  derived and/or modified sequence opt5 from hemagglutinin__InfluenzaA__ACR77468

SEQ ID NO: 185948 - RNA, 1701 nt, Artificial Sequence; identical to SEQ ID NO: 185693
  derived and/or modified sequence opt5 from hemagglutinin__InfluenzaA__ACR77478

SEQ ID NO: 185949 - RNA, 1701 nt, Artificial Sequence; identical to SEQ ID NO: 185693
  derived and/or modified sequence opt5 from hemagglutinin__InfluenzaA__ACR77488

SEQ ID NO: 185950 - RNA, 1701 nt, Artificial Sequence; identical to SEQ ID NO: 185693
  derived and/or modified sequence opt5 from hemagglutinin__InfluenzaA__ACR77498

SEQ ID NO: 185951 - RNA, 1701 nt, Artificial Sequence; identical to SEQ ID NO: 185680
  derived and/or modified sequence opt5 from hemagglutinin__InfluenzaA__ACR83525

SEQ ID NO: 185952 - RNA, 1701 nt, Artificial Sequence
  derived and/or modified sequence opt5 from hemagglutinin__InfluenzaA__ACR83538
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccucucccgcggacuguuuggcgccauugccggguucaucgagggaggcuggaccgggaugguggacggaugguacggcuaucaucaccagaaugaacagggcucuggguacgcugcggaucuuaaaagcacacaaaacgccaucgacgagauuaccaauaaggucaacuccgugaucgagaaaaugaauacgcaguuuacagcuguuggaaaggaguucaaccaccuggagaagagaauugaaaaucucaacaaaaagguggaugacggcuuccuggauaucuggaccuacaaugccgagcugcucguccugcuugaaaacgagcggacccuggacuaucaugauagcaaugugaaaaaccucuacgagaagguccgcucucagcugaaaaacaaugccaaggaaauugggaacggauguuuugaguucuaucacaagugcgacaauacauguauggaauccgugaaaaacggcaccuacgauuauccuaaguacagcgaggaagcuaaacuuaauagagaggagaucgacgggguuaagcuggaaucuacacggaucuaucagauucucgccaucuacuccacgguggcgagcucccugguccuggugguuucucucggcgcuauuagcuuuuggaugugcuccaacggaucucugcaaugccgcaucuguauuuga

SEQ ID NO: 185953 - RNA, 1701 nt, Artificial Sequence; identical to SEQ ID NO: 185693
  derived and/or modified sequence opt5 from hemagglutinin__InfluenzaA__ACS14666

SEQ ID NO: 185954 - RNA, 1701 nt, Artificial Sequence; identical to SEQ ID NO: 185693
  derived and/or modified sequence opt5 from hemagglutinin__InfluenzaA__ACS14676

SEQ ID NO: 185955 - RNA, 1701 nt, Artificial Sequence; identical to SEQ ID NO: 185693
  derived and/or modified sequence opt5 from hemagglutinin__InfluenzaA__ACS14686

SEQ ID NO: 185956 - RNA, 1701 nt, Artificial Sequence; identical to SEQ ID NO: 185693
  derived and/or modified sequence opt5 from hemagglutinin__InfluenzaA__ACS14696

SEQ ID NO: 185957 - RNA, 1701 nt, Artificial Sequence; identical to SEQ ID NO: 185693
  derived and/or modified sequence opt5 from hemagglutinin__InfluenzaA__ACS14706

SEQ ID NO: 185958 - RNA, 1701 nt, Artificial Sequence; identical to SEQ ID NO: 185693
  derived and/or modified sequence opt5 from hemagglutinin__InfluenzaA__ACS14716

SEQ ID NO: 185959 - RNA, 1701 nt, Artificial Sequence; identical to SEQ ID NO: 185693
  derived and/or modified sequence opt5 from hemagglutinin__InfluenzaA__ACS14726

SEQ ID NO: 185960 - RNA, 1701 nt, Artificial Sequence; identical to SEQ ID NO: 185693
  derived and/or modified sequence opt5 from hemagglutinin__InfluenzaA__ACS14736

SEQ ID NO: 185961 - RNA, 1701 nt, Artificial Sequence; identical to SEQ ID NO: 185873
  derived and/or modified sequence opt5 from hemagglutinin__InfluenzaA__ACS27189

SEQ ID NO: 185962 - RNA, 1701 nt, Artificial Sequence; identical to SEQ ID NO: 185693
  derived and/or modified sequence opt5 from hemagglutinin__InfluenzaA__ACS27199

SEQ ID NO: 185963 - RNA, 1701 nt, Artificial Sequence; identical to SEQ ID NO: 185693
  derived and/or modified sequence opt5 from hemagglutinin__InfluenzaA__ACS27209

SEQ ID NO: 185964 - RNA, 1701 nt, Artificial Sequence; identical to SEQ ID NO: 185746
  derived and/or modified sequence opt5 from hemagglutinin__InfluenzaA__ACS27219

SEQ ID NO: 185965 - RNA, 1701 nt, Artificial Sequence; identical to SEQ ID NO: 185693
  derived and/or modified sequence opt5 from hemagglutinin__InfluenzaA__ACS27229

SEQ ID NO: 185966 - RNA, 1701 nt, Artificial Sequence
  derived and/or modified sequence opt5 from hemagglutinin__InfluenzaA__ACS27239
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcaugucuuccuucgaacgcuuugagaucuuccccaagaccagcucuuggccuaaucacgauuccaacaagggagucacagccgcuuguccccaugccggcgcgaaaucuuuuuauaagaaucugaucuggcucgugaaaaagggcaacagcuacccuaaacuguccaagagcuauauuaaugacaaggggaaagaaguucuugugcuguggggaauccaccaccccuccaccucugccgaucaacagagccucuaccagaacgcugacgccuacgucuucgugggcuccagcagauauucuaagaaauuuaagccugagauugcuauccggccgaaagugcgcgaucaggaggggagaaugaauuacuauuggacacuggucgaacccggagacaagauuaccuucgaggccacgggcaaccugguugugccucgguacgcguuugccauggaacgcaacgcuggguccggaaucauuaucagcgauacacccgugcaugacugcaauaccacaugucaaaccccuaaaggcgccaucaacaccucucuccccuuccagaauauucacccgaucacaauuggcaagugcccuaaguaugucaaaagcacgaagcugagacuugcuaccgggcugcggaacgugcccuccauccagucucgcggacucuuuggcgccauugccggguucaucgagggaggcuggacagggaugguugacggaugguacggcuaucaucaccagaaugaacaaggcagcggguacgcugcggaucugaaauccacccagaacgccaucgacgagauuacaaauaaggugaacagcgucaucgagaaaaugaauacccaguuuacggcugugggaaaggaguucaaccaccuugagaagagaauugaaaaucugaacaaaaagguugaugacggcuuccucgauaucuggacauacaaugccgagcugcuggugcuccuggaaaacgagcggacccuugacuaucaugauucuaaugucaaaaaccuguacgagaaggugcgcucccagcucaaaaacaaugccaaggaaauugggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggaucuaucaaauucuggccaucuacagcacaguugcguccucucucgugcuggucgugagccugggcgcuauuuccuuuuggaugugcucuaacggaagccuccagugccgcaucuguauuuga

SEQ ID NO: 185967 - RNA, 1701 nt, Artificial Sequence; identical to SEQ ID NO: 185693
  derived and/or modified sequence opt5 from hemagglutinin__InfluenzaA__ACS27249

SEQ ID NO: 185968 - RNA, 1701 nt, Artificial Sequence; identical to SEQ ID NO: 185693
  derived and/or modified sequence opt5 from hemagglutinin__InfluenzaA__ACS27775

SEQ ID NO: 185969 - RNA, 1701 nt, Artificial Sequence; identical to SEQ ID NO: 185680
  derived and/or modified sequence opt5 from hemagglutinin__InfluenzaA__ACS34705

SEQ ID NO: 185970 - RNA, 1701 nt, Artificial Sequence; identical to SEQ ID NO: 185680
  derived and/or modified sequence opt5 from hemagglutinin__InfluenzaA__ACS34966

SEQ ID NO: 185971 - RNA, 1701 nt, Artificial Sequence
  derived and/or modified sequence opt5 from hemagglutinin__InfluenzaA__ACS34967
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaaguccagacuggcuaccgggcuucggaacguucccucuauccagagccgcggacuguuuggcgccauugccggguucaucgagggaggcuggacagggaugguggacggaugguacggcuaucaucaccagaaugaacaaggcuccggguacgcugcggaucucaaaagcacccagaaggccaucgacgagauuacaaacaaagucaauucugugaucgagaagaugaacacccaguuuacggcuguuggaaaggaguucaaucaccuggagaaaagaauugaaaaccuuaauaagaaaguggaugacggcuuccuggauaucuggacauacaacgccgagcuccugguccugcucgaaaaugagcggacccuggacuaucaugauuccaacgugaagaaucuuuacgagaaaguccgcagccagcugaagaacaacgccaaggaaauugggaauggauguuuugaguucuaucacaaaugcgacaacaccuguauggaaucugugaagaauggcacauacgauuauccuaaauacuccgaggaagcuaagcucaacagagaggagaucgacgggguuaaacuggaaagcacccggaucuaucaaauucuugccaucuacuccacaguggcgucuagccugguccucgugguuucccugggcgcuauuucuuuuuggaugugcagcaauggaucccugcagugccgcaucuguauuuga

SEQ ID NO: 185972 - RNA, 1701 nt, Artificial Sequence
  derived and/or modified sequence opt5 from hemagglutinin__InfluenzaA__ACS34968
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggaguccucuagcuccgacaacgggaccugcuauccgggcgauuuuauugacuacgaagaacugcgggagcagcuuagcucugucuccagcuucgaacgcuuugagaucuuccccaagacgucuuccuggccuaaucacgauagcaacaagggagugaccgccgcuuguccccaugccggcgcgaaaucuuuuuauaagaaucugaucuggcucguuaaaaagggcaacuccuacccuaaacugagcaaguccuauauuaaugacaaggggaaagaagugcuuguccuguggggaauccaccaccccucuacaagcgccgaucaacagucccucuaccagaacgcugacgccuacguguucgugggcagcucuagauauuccaagaaauuuaagccugagauugcuauccggccgaaaguccgcgaucaggaggggagaaugaauuacuauuggacccugguugaacccggagacaagauuaucuucgaggccacaggcaaccugguggugccucgguacgcguuugccauggaacgcaacgcugggagcggaauuaucaucucugauacccccguccaugacugcaauacgacaugucaaaccccuaaaggcgccauuaacacaagccuccccuuccagaauauccacccgauuaccaucggcaagugcccuaaguaugugaaauccaccaagcugagacuugcuacagggcugcggaacguucccucuauucagagccgcggacucuuuggcgccaucgccggguucaucgagggaggcuggacggggaugguggacggaugguacggcuaucaucaccagaaugaacaaggcuccggguacgcugcggaucugaaaagcacccagaacgccauugacgagaucacaaauaaggucaacucugugauugagaaaaugaauacccaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacgcuugacuaucaugauuccaaugugaaaaaccuguacgagaagguccgcagccagcucaaaaacaaugccaaggaaaucgggaacggauguuuugaguucuaucacaagugcgacaauacauguauggaaucugugaaaaacggcaccuacgauuauccuaaguacuccgaggaagcuaaacugaauagagaggagaucgacgggguuaaacuugaaagcacccggauuuaucaaauccuggccauuuacuccacaguggcgucuagccucguccuggugguuucccugggcgcuaucucuuuuuggaugugcagcaacggaucccuccagugccgcauuuguaucuga

SEQ ID NO: 185973 - RNA, 1701 nt, Artificial Sequence
  derived and/or modified sequence opt5 from hemagglutinin__InfluenzaA__ACS36632
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaaggccaucgacgagauuacaaacaaagucaauagcgugaucgagaagaugaacacccaguuuacggcuguuggaaaggaguucaaucaccuugagaaaagaauugaaaaccugaauaagaaaguggaugacggcuuccucgauaucuggacauacaacgccgagcugcugguccuccuggaaaaugagcggacccuugacuaucaugauucuaacgugaagaaucuguacgagaaaguccgcucccagcucaagaacaacgccaaggaaauugggaauggauguuuugaguucuaucacaaaugcgacaacaccuguauggaaagcgugaagaauggcacauacgauuauccuaaauacucugaggaagcuaagcugaacagagaggagaucgacgggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 185974 - RNA, 1701 nt, Artificial Sequence
  derived and/or modified sequence opt5 from hemagglutinin__InfluenzaA__ACS36645
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcaccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcuccagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaagcaacgccaaggaaauugggaauggauguuuugaguucuaucacaagugcgacaacacauguauggaaucugugaaaaauggcaccuacgauuauccuaaguacuccgaggaagccaaacugaacagagaggagaucgacgggaucaaacuugaaagcacacggauuuaucaaauccuggcuauuuacuccacgguugccucuagccucgugcuggucgugucccugggcgcgaucucuuuuuggaugugcagcaauggaucccuccagugccgcauuuguaucuga

SEQ ID NO: 185975 - RNA, 1701 nt, Artificial Sequence
  derived and/or modified sequence opt5 from hemagglutinin__InfluenzaA__ACS45035
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccccguccucugacaacggcacgugcuaucccggggauuuuauugacuacgaagaacugcgggagcagcuuagcuccgucagcucuuucgaacgcuuugagaucuucccuaagaccuccagcuggcccaaucacgauucuaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucuauuuaccagaacgcugacacauacguguucgugggcagcuccagauauagcaagaaauuuaagccggagaucgccauucggcccaaaguccgcgaucaggaggggagaaugaauuacuauuggacccucguugaaccuggagacaagaucacguucgaggcuacaggcaaccugguggugccccgguacgccuuugcgauggaacgcaacgccgggucuggaauuaucaucuccgauaccccuguccaugacugcaauacaaccugucaaacccccaaaggcgcuauuaacacaagccugccguuccagaauauccacccuauuacgaucggcaagugccccaaguaugugaaaucuaccaagcucagacuggccacagggcuucggaacauuccuagcauccagucccgcggacuguuuggcgcuaucgccggguucauugagggaggcuggaccgggaugguugacggaugguacggcuaucaucaccagaaugaacaaggcucuggguacgccgcugaucucaaaagcacacagaacgcgaucgacgagauuaccaauaaggugaacuccgucaucgagaaaaugaauacgcaguuuacagccgugggaaaggaguucaaccaccuggagaagagaauugaaaaucuuaacaaaaagguugaugacggcuuccuggauaucuggaccuacaaugcugagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccgucaaaaacggcaccuacgauuaucccaaguacagcgaggaagccaaacucaauagagaggagauugacggggugaagcuggaaucuacacggaucuaucaaauucuugcuaucuacuccacgguugccagcucccuggugcucgucgugucucugggcgcgauuagcuuuuggaugugcuccaacggaucucugcagugccgcaucuguauuuga

SEQ ID NO: 185976 - RNA, 1701 nt, Artificial Sequence; identical to SEQ ID NO: 185693
  derived and/or modified sequence opt5 from hemagglutinin__InfluenzaA__ACS50084

SEQ ID NO: 185977 - RNA, 1701 nt, Artificial Sequence; identical to SEQ ID NO: 185935
  derived and/or modified sequence opt5 from hemagglutinin__InfluenzaA__ACS50095

SEQ ID NO: 185978 - RNA, 1701 nt, Artificial Sequence
  derived and/or modified sequence opt5 from hemagglutinin__InfluenzaA__ACS54258
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacuauuacccuaaguauagcgaggaagcuaaacugaauagagaggagaucgaugggguuaaacuugaaucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 185979 - RNA, 1701 nt, Artificial Sequence; identical to SEQ ID NO: 185708
  derived and/or modified sequence opt5 from hemagglutinin__InfluenzaA__ACS54259

SEQ ID NO: 185980 - RNA, 1701 nt, Artificial Sequence; identical to SEQ ID NO: 185680
  derived and/or modified sequence opt5 from hemagglutinin__InfluenzaA__ACS54260

SEQ ID NO: 185981 - RNA, 1701 nt, Artificial Sequence; identical to SEQ ID NO: 185693
  derived and/or modified sequence opt5 from hemagglutinin__InfluenzaA__ACS54261

SEQ ID NO: 185982 - RNA, 1701 nt, Artificial Sequence; identical to SEQ ID NO: 185693
  derived and/or modified sequence opt5 from hemagglutinin__InfluenzaA__ACS54263

SEQ ID NO: 185983 - RNA, 1701 nt, Artificial Sequence; identical to SEQ ID NO: 185693
  derived and/or modified sequence opt5 from hemagglutinin__InfluenzaA__ACS54301

SEQ ID NO: 185984 - RNA, 1701 nt, Artificial Sequence; identical to SEQ ID NO: 185680
  derived and/or modified sequence opt5 from hemagglutinin__InfluenzaA__ACS66821

SEQ ID NO: 185985 - RNA, 1701 nt, Artificial Sequence
  derived and/or modified sequence opt5 from hemagglutinin__InfluenzaA__ACS68822
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaaggacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccagaacgcugacgccuacguguucguggggacauccagauauagcaagaaauuuaagccugaaauugcuauccggccgaaaguccgcgaucaggagggaagaaugaauuacuauuggacccugguugagcccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacgaaauuaccaauaaggucaacuccgugaucgagaaaaugaauacgcaguuuacagcuguuggcaaggaguucaaccaccuugaaaagagaauugagaaucugaacaaaaagaucgaugacggguuccucgauauuuggaccuacaaugccgaacugcuggugcuccuggagaacgaacggacccuugacuaucaugauagcaaugucaaaaaccuguacgagaaggugcgcucucagcucaaaaacaaugccaaggagaucggaaacggcuguuuugaguucuaucacaagugcgacaauacauguauggaauccgucaaaaacgggaccuacgauuauccuaaguacagcgaagaggcuaaacugaauagagaagagaucgacggcgugaaacuugagucuacacggauuuaucaaauccuggccauuuacuccacgguugcgagcucccucgugcuggucgugucucugggagcuaucagcuuuuggaugugcuccaacggcucucuccagugccgcauuuguaucuga

SEQ ID NO: 185986 - RNA, 1701 nt, Artificial Sequence; identical to SEQ ID NO: 185693
  derived and/or modified sequence opt5 from hemagglutinin__InfluenzaA__ACS75821

SEQ ID NO: 185987 - RNA, 1701 nt, Artificial Sequence; identical to SEQ ID NO: 185693
  derived and/or modified sequence opt5 from hemagglutinin__InfluenzaA__ACS77926

SEQ ID NO: 185988 - RNA, 1701 nt, Artificial Sequence; identical to SEQ ID NO: 185693
  derived and/or modified sequence opt5 from hemagglutinin__InfluenzaA__ACS77936

SEQ ID NO: 185989 - RNA, 1701 nt, Artificial Sequence; identical to SEQ ID NO: 185786
  derived and/or modified sequence opt5 from hemagglutinin__InfluenzaA__ACS77946

SEQ ID NO: 185990 - RNA, 1701 nt, Artificial Sequence; identical to SEQ ID NO: 185693
  derived and/or modified sequence opt5 from hemagglutinin__InfluenzaA__ACS77956

SEQ ID NO: 185991 - RNA, 1701 nt, Artificial Sequence; identical to SEQ ID NO: 185693
  derived and/or modified sequence opt5 from hemagglutinin__InfluenzaA__ACS77966

SEQ ID NO: 185992 - RNA, 1701 nt, Artificial Sequence; identical to SEQ ID NO: 185693
  derived and/or modified sequence opt5 from hemagglutinin__InfluenzaA__ACS77976

SEQ ID NO: 185993 - RNA, 1701 nt, Artificial Sequence; identical to SEQ ID NO: 185935
  derived and/or modified sequence opt5 from hemagglutinin__InfluenzaA__ACS77986

SEQ ID NO: 185994 - RNA, 1701 nt, Artificial Sequence
  derived and/or modified sequence opt5 from hemagglutinin__InfluenzaA__ACS77996
augaaggccacccuggugguccuccuguacacauucgcuacggccaacgcggacacccuuugcaucggcuaucacgcuaauaacagcacagauaccguugacacagugcuggagaagaaugugaccgucacacauuccgugaaccuccuggaagauaagcacaaugggaaacuuuguaagcugagaggaguugcuccccuccaucugggcaaaugcaacauugccggguggauccugggaaauccugagugugaaucucucagcaccgccuccucuuggagcuacauuguggagacguccucuagcgacaacggaaccugcuauccgggggauuuuaucgacuacgaagaacugcgggagcagcuuuccagcgucucuuccuucgaacgcuuugagauuuuccccaagacaagcucuuggccuaaucacgauuccaacaagggagugaccgccgcuuguccccaugccggcgcgaaaucuuuuuauaagaaucugaucuggcucguuaaaaagggcaacagcuacccuaaacuguccaagagcuauaucaaugacaaggggaaagaagugcuuguccuguggggcauucaccaccccuccacaucugccgaucaacagagccucuaccagaacgcugacgccuacguguucgugggcaccuccagauauagcaagaaauuuaagccugagaucgcuauucggccgaaaguccgcgaucaggaggggagaaugaauuacuauuggacgcugguugaacccggagacaagaucacauucgaggccaccggcaaccugguggugccucgguacgcguuugccauggaacgcaacgcugggucuggaauuaucauuuccgauacacccguccaugacugcaauaccaccugucaaacaccuaaaggcgccaucaacacgagccuccccuuccagaauauccacccgauuaccaucggcaagugcccuaaguaugugaaaucuacaaagcugagacuugcuaccgggcugcggaacguucccagcauucagucccgcggacucuuuggcgccaucgccggguucauugagggaggcuggacagggaugguggacggaugguacggcuaucaucaccagaaugaacaaggcucuggguacgcugcggaucugaaaagcacccagaacgccaucgacgagaucacgaauaaggucaacuccgugauugagaaaaugaauacacaguuuaccgcuguuggaaaggaguucaaccaccuugagaagagaaucgaaaaucugaacaaaaagguggaugacggcuuccucgauauuuggaccuacaaugccgagcugcugguccuccuggaaaacgagcggacacuugacuaucaugauagcaaugugaaaaaccuguacgagaagguccgcucucagcucaaaaacaaugccaaggaaaucgggaacggauguuuugaguucuaucacaagugcgacaauaccuguauggaauccgugaaaaacggcacauacgauuauccuaaguacagcgaggaagcuaaacugaauagagaggagauugacgggguuaaacuugaaucuacgcggaucuaucaaauccuggccauuuacuccaccguggcgagcucccucguccuggugguuucucugggcgcuaucagcuuuuggaugugcuccaacggaucucuccagugccgcauuuguaucuga

SEQ ID NO: 185995 - RNA, 1701 nt, Artificial Sequence; identical to SEQ ID NO: 185693
  derived and/or modified sequence opt5 from hemagglutinin__InfluenzaA__ACS78006

SEQ ID NO: 185996 - RNA, 1701 nt, Artificial Sequence; identical to SEQ ID NO: 185693
  derived and/or modified sequence opt5 from hemagglutinin__InfluenzaA__ACS78016

SEQ ID NO: 185997 - RNA, 1701 nt, Artificial Sequence
  derived and/or modified sequence opt5 from hemagglutinin__InfluenzaA__ACS78026
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcgccccuccaucugggcaaaugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaucagcucuuggccuaaucacgauuccaacagaggagugaccgccgcuuguccccaugccggcgccaagagcuuuuauaaaaaucugauuuggcucguuaagaaaggcaacucuuacccuaagcugaucaaauccuauauuaaugacaaggggaaggaagugcuuguccuguggggaauccaccaccccagcacauccgccgaucaacagucucucuaccagaacgcugacgccuacguguucgugggcagcucccgguauagcaaaaaguuuaaaccugagauugcuauccgcccgaaggucagagaucaggaggggcggaugaauuacuauuggacccugguugaacccggagacaaaauuacauucgaggccaccggcaaccugguggugccucgcuacgcguuugccauggaaagaaacgcugggucuggaaucaucauuuccgauacgcccguccaugacugcaauacaaccugucaaacaccuaagggcgccaucaacaccagccuccccuuccagaauauucacccgaucaccauuggcaaaugcccuaaguaugugaagucuacaaaacugcggcuugcuacggggcugcgcaacguucccagcauccaguccagaggacucuuuggcgccaucgccggguucauugagggaggcuggaccgggaugguggacggaugguacggcuaucaucaccagaaugaacaaggcucuggguacgcugcggaucuuaagagcacacagaacgccaucgacgagauuaccaauaaagucaacuccgugaucgagaagaugaauacacaguuuaccgcuguuggaaaagaguucaaccaccuggagaagcggauugaaaaucugaacaagaaaguggaugacggcuuccucgauaucuggacguacaaugccgagcugcugguccuccuggaaaacgagcgcacacuugacuaucaugauagcaaugugaagaaccuguacgagaaagucagaucucagcucaagaacaaugccaaagaaaucgggaacggauguuuugaguucuaucacaagugcgacaauaccuguauggaauccgugaagaacggcaccuacgauuauccuaaauacagcgaggaagcuaagcugaaucgggaggagauugacgggguuaaacuugaaucuacacgcaucuaucaaauucuggccaucuacuccaccguggcgagcucccucguccuggugguuucucugggcgcuauuagcuuuuggaugugcuccaacggaucucuccagugcagaaucuguauuuga

SEQ ID NO: 185998 - RNA, 1701 nt, Artificial Sequence; identical to SEQ ID NO: 185935
  derived and/or modified sequence opt5 from hemagglutinin__InfluenzaA__ACS78036

SEQ ID NO: 185999 - RNA, 1701 nt, Artificial Sequence; identical to SEQ ID NO: 185935
  derived and/or modified sequence opt5 from hemagglutinin__InfluenzaA__ACS78046

SEQ ID NO: 186000 - RNA, 1701 nt, Artificial Sequence; identical to SEQ ID NO: 185708
  derived and/or modified sequence opt5 from hemagglutinin__InfluenzaA__ACS92569

SEQ ID NO: 186001 - RNA, 1701 nt, Artificial Sequence; identical to SEQ ID NO: 185708
  derived and/or modified sequence opt5 from hemagglutinin__InfluenzaA__ACS92579

SEQ ID NO: 186002 - RNA, 1701 nt, Artificial Sequence; identical to SEQ ID NO: 185693
  derived and/or modified sequence opt5 from hemagglutinin__InfluenzaA__ACS92589

SEQ ID NO: 186003 - RNA, 1701 nt, Artificial Sequence
  derived and/or modified sequence opt5 from hemagglutinin__InfluenzaA__ACS92612
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuauccacgauuccaauaagggagugacagccgcuuguccccaugccggcgcgaaaucuuuuuauaagaaccugauuuggcucguuaaaaagggcaauagcuacccuaaacuguccaagagcuauaucaacgacaaggggaaagaagugcuuguccuguggggcauucaccaccccuccaccucugccgaucaacagagccucuaccagaaugcugacgccuacguguucgugggauccagcagauauucuaagaaauuuaagccugagaucgcuauucggccgaaaguccgcgaucaggaggggagaaugaacuacuauuggacacugguugaacccggagacaagaucaccuucgaggccacgggcaaucugguggugccucgguacgcguuugccauggaacgcaacgcuggguccggaauuaucaucagcgauacacccguccaugacugcgacaccacaugucaaaccccuaaaggcgccauuaacaccucucuccccuuccagaauauccacccgauuacaaucggcaagugcccuaaguaugugaaaagcacgaagcugagacuugcuaccgggcugcggaacauucccuccauccagucucgcggacucuuuggcgccaucgccggguucauugagggaggcuggacagggaugguugauggaugguacggcuaucaucaccagaaugaacaaggcagcggguacgcugcggaccugaaauccacccagaacgccaucgaugagauuacaaauaaggugaacagcgucaucgagaaaaugaauacccaguuuacggcugugggaaaggaguucaaccaccuugagaagagaauugaaaaucugaacaaaaagguugacgauggcuuccucgacaucuggacauacaaugccgagcugcuggugcuccuggaaaacgagcggacccuugauuaucaugacucuaaugucaaaaaccuguacgagaaggugcgcucccagcucaaaaauaacgccaaggaaaucgggaacggauguuuugaguucuaucacaagugcgauaauaccuguauggaaagcgucaaaaacggcacauacgacuauccuaaguacucugaggaagcuaaacugaauagagaggagauugauggggugaaacuugaauccacccggaucuaucaaauucuggccaucuacagcacaguugcguccucucucgugcuggucgugagccugggcgcuauuuccuuuuggaugugcucuaacggaagccuccagugccgcaucuguauuuga

SEQ ID NO: 186004 - RNA, 1701 nt, Artificial Sequence; identical to SEQ ID NO: 185693
  derived and/or modified sequence opt5 from hemagglutinin__InfluenzaA__ACT10307

SEQ ID NO: 186005 - RNA, 1701 nt, Artificial Sequence; identical to SEQ ID NO: 185693
  derived and/or modified sequence opt5 from hemagglutinin__InfluenzaA__ACT10314

SEQ ID NO: 186006 - RNA, 1701 nt, Artificial Sequence
  derived and/or modified sequence opt5 from hemagglutinin__InfluenzaA__ACT11057
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaguggggaacggauguuuugaguucuaucacaagugcgacaauaccuguauggaaagcguuaaaaacggcacauacgauuauccuaaguacucugaggaagcuaaacucaauagagaggagaucgacggggugaagcuggaauccacccggaucuaucaaauucuugccaucuacagcacagucgcguccucucuggugcucguugugagccugggcgcuauuuccuuuuggaugugcucuaacggaagccugcagugccgcaucuguauuuga

SEQ ID NO: 186007 - RNA, 1704 nt, Artificial Sequence
  derived and/or modified sequence opt5 from hemagglutinin__InfluenzaA__ACT15312
auggagaagaucgugcugcuccuggccauugucagcaucguuaaauccgaccagauuugcaucggcuaccacgcuaacaauucuaccgaacaaguggauacaauuauggagaagaacgugacggucacccaugcccaggacauccuugaaaagacacacaaugggaaacuguguaaccucgauggagugaaaccccugauccuuagagacugcagcguugcgggcuggcugcucgggaauccuaugugugaugaguuccugaacgugccggaaugguccuauauugucgagaagaucaaucccgcuaacgaccugugcuacccuggaaauuuuaacgauuaugaggaacucaagcaucugcuuucucggauuaaucacuucgagaaaauccagauuauccccaagaacagcugguccgaccaugaagccucuggcgugagcuccgccuguccuuaccaggggcgcagcuccuuuuucagaaauguuguguggcugaccaaaaagaacaaugcuuaucccacaauuaaacggucuuacaacaacaccaaucaagaggaucuccugguccuuuggggaauccaccacccuaacgacgccgcugagcagacacgccuguaucagaauccgaccacguacaucagcgugggcaccucuacacucaaccagagacuggugcccaagauugccacccgguccaaggucaauggccaaagcgggcgcauggaauuuuucuggacaauccugaaaucuaacgaugcgauuaauuuugaguccaacggaaauuucaucgccccugaaaacgcuuacaagauuguuaaaaagggcgacagcaccaucaugaaauccgagcucgaauaugggaauugcaacacgaagugucagacacccaucggagccauuaauucuagcaugccuuuucauaacauccacccccugaccauuggcgagugcccgaaauacgugaaguccaauagacuugugcuggcuacagggcuccggaacagcccucagggagagcgcagacggaagaaacgcggccuguucggcgccaucgcgggguuuauugaaggaggcuggcaggggauggucgauggaugguauggcuaccaucacucuaacgagcaaggguccggauaugccgcugacaaggaaagcacccagaaagccaucgacggcgugaccaauaagguuaacucuaucauugauaaaaugaauacacaguucgaggcugugggcagagaauuuaacaaucuugagcggcgcaucgagaaccugaauaagaagauggaagacggguuccucgaugucuggacguacaacgccgagcugcuggugcucauggaaaaugagagaacccuggacuuccacgauagcaacguuaaaaaucuuuaugacaaggugcggcugcaacucagagauaacgccaaagaacugggaaauggcuguuuugaguucuaccaucgcugcgacaacgaguguauggaauccguccggaaugggacauacgauuauccccaguacucugaggaagcuagacuuaagcgcgaggagauuagcggagugaaacuggaauccaucggcaccuaucagauucucagcaucuacucuacagucgcguccagccuggcccuggcuauuaugguggccgggcucuuucuguggaugugcucuaacggcucccuucagugccggaucuguaucuga

SEQ ID NO: 186008 - RNA, 1704 nt, Artificial Sequence
  derived and/or modified sequence opt5 from hemagglutinin__InfluenzaA__ACT15314
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaagaacaaugcuuaucccacaaucaaacggucuuacaacaacaccaaucaagaggaucugcuuguccuguggggcauucaccacccuaacgacgccgcugagcagacacgccucuaucagaauccgaccacguacaucagcgugggaaccucuacacugaaccagagacuggugcccaagaucaccacacgguccaaggucaauggccaaagcgggcgcauggaauuuuucuggaccauucucaaaucuaacgaugccaucaauuuugaguccaacggaaauuucauugcgccugaaaacgccuacaagaucguuaaaaagggcgacagcacgauuaugaaauccgagcuggaauaugggaauugcaacacaaagugucagacccccaucggagcuaucaauucuagcaugccuuuucauaacauucacccccuuacaaucggcgagugcccgaaauacgugaaguccaauagacuggugcucgccaccgggcugcggaacagcccucagggagagcgcagacggaagaaacgcggccuuuucggcgcuauugccggguuuaucgaaggaggcuggcaggggauggucgauggaugguauggcuaccaucacucuaacgagcaaggguccggauaugcggccgacaaggaaagcacccagaaagcuauugacggcgugacaaauaagguuaacucuaucaucgauaaaaugaauacgcaguucgaggccgugggcagagaauuuaacaaucuggagcggcgcauugagaaccucaauaagaagauggaagacggguuccuggaugucuggaccuacaacgcugagcugcucgugcugauggaaaaugagagaacacuugacuuccacgauagcaacguuaaaaaucuguaugacaaggugcggcuccaacugagagauaacgccaaagaacuuggaaauggcuguuuugaguucuaccaucgcugcgacaacgaguguauggaauccguccggaaugggaccuacgauuauccccaguacucugaggaagccagacugaagcgcgaggagaucagcggagugaaacucgaauccauuggcacauaucagauccugagcauuuacucuaccgucgcuuccagccuggcgcucgccaucaugguggcugggcuguuucuuuggaugugcucuaacggcucccugcagugccggauuuguaucuga

SEQ ID NO: 186009 - RNA, 1704 nt, Artificial Sequence
  derived and/or modified sequence opt5 from hemagglutinin__InfluenzaA__ACT15316
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccgcugagcagacacgccucuaucagaacccgaccacguacaucagcgugggaaccucuacacugaaucagagacugauccccaagauugccacccgguccaaggugaacggccaaagcgggcgcauggaauuuuucuggacaauccucaaaucuaaugacgcgauuaacuuugaguccaauggaaacuucaucgccccugaaaaugcuuacaagauugucaaaaagggcgauagcaccaucaugaaauccgagcuggaauaugggaacugcaauacgaagugucagacacccaucggagccauuaacucuagcaugccuuuucauaauauccacccccuuaccauuggcgagugcccgaaauacguuaaguccaacagacuggugcucgcuacagggcugcggaauagcccucagggagagcgcagacggaagaaacgcggccuuuucggcgccaucgcgggguuuauugaaggaggcuggcaggggaugguggacggaugguauggcuaccaucacucuaacgagcaaggguccggauaugccgcugacaaggaaagcacccagaaagccaucgauggcgucaccaacaagguuaauucuaucauugacaaaaugaacacacaguucgaggcugugggcagagaauuuaauaaccuggagcggcgcaucgagaaucucaacaagaagauggaagauggguuccuggacguguggacguacaaugccgagcugcucguccugauggaaaacgagagaacccuugauuuccacgacagcaaugugaaaaaccuguaugauaagguucggcuccaacugagagacaaugccaaagaacuuggaaacggcuguuuugaguucuaccaucgcugcgauaaugaguguauggaauccgugcggaacgggacauacgacuauccccaguacucugaggaagcuagacugaagcgcgaggagauuagcggagucaaacucgaauccaucggcaccuaucagauucugagcaucuacucuacaguggcguccagccuggcccucgcuauuauggucgccgggcuguuucuuuggaugugcucuaauggcucccugcagugccggaucuguaucuga

SEQ ID NO: 186010 - RNA, 1704 nt, Artificial Sequence
  derived and/or modified sequence opt5 from hemagglutinin__InfluenzaA__ACT15320
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcaugagcuccgccuguccuuaccaggggcgcagcuccuuuuucagaaaugugguuuggcucaccaaaaaggauaacgcuuaucccacaaucaaacggucuuacaauaacaccaaccaagaggaccugcuugugcuguggggcauucaccacccuaaugaugccgcugagcagacacgccucuaucagaacccgaccacguacaucagcgucggaaccucuacacugaaucagagacuggugcccaagaucgccacccgguccaaggugaacggccaaagcgggcgcauggaauuuuucuggacaauucucaaaucuaaugacgcgaucaacuuugaguccaauggaaacuucauugccccugaaaaugcuuacaagaucgucaaaaagggcgauagcaccauuaugaaauccgagcuggaauaugggaacugcaauacgaagugucagacacccaucggagccaucaacucuagcaugccuuuucauaauauucacccccuuaccaucggcgagugcccgaaauacguuaaguccaacagacuggugcucgcuacagggcugcggaauagcccucagggagagcgcagacggaagaaacgcggccuuuucggcgccauugcgggguuuaucgaaggaggcuggcaggggaugguggacggaugguauggcuaccaucacucuaacgagcaaggguccggauaugccgcugacaaggaaagcacccagaaagccauugauggcgucaccaacaagguuaauucuaucaucgacaaaaugaacacacaguucgaggcugugggcagagaauuuaauaaccuggagcggcgcauugagaaucucaacaagaagauggaagauggguuccuggacguguggacguacaaugccgagcugcucguccugauggaaaacgagagaacccuugauuuccacgacagcaaugugaaaaaccuguaugauaagguucggcuccaacugagagacaaugccaaagaacuuggaaacggcuguuuugaguucuaccaucgcugcgauaaugaguguauggaauccgugcggaacgggacauacgacuauccccaguacucugaggaagcuagacugaagcgcgaggagaucagcggagucaaacucgaauccauuggcaccuaucagauccugagcauuuacucuacaguggcguccagccuggcccucgcuaucauggucgccgggcuguuucuuuggaugugcucuaauggcucccugcagugccggauuuguaucuga

SEQ ID NO: 186011 - RNA, 1704 nt, Artificial Sequence
  derived and/or modified sequence opt5 from hemagglutinin__InfluenzaA__ACT15322
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccgcugagcagacacgccucuaucagaacccgaccacguacaucagcgugggaaccucuacacugaaucagagacuggugcccaagaucgccacccgguccaaggucaacggccaaagcgggcgcauggaauuuuucuggacaauucucaaaucuaaugacgcgaucaacuuugaguccaauggaaacuucauugccccugaaaaugcuuacaagaucguuaaaaagggcgauagcaccauuaugaaauccgagcuggaauaugggaacugcaauacgaagugucagacacccaucggagccaucaacucuagcaugccuuuucauaauauucacccccuuaccaucggcgagugcccgaaauacgugaaguccaacagacuggugcucgcuacagggcugcggaauagcccucagggagagcgcagacggaagaaacgcggccuuuucggcgccauugcgggguuuaucgaaggaggcuggcaggggauggucgacggaugguauggcuaccaucacucuaacgagcaaggguccggauaugccgcugacaaggaaagcacccagaaagccauugauggcgugaccaacaagguuaauucuaucaucgacaaaaugaacacacaguucgaggcugugggcagagaauuuaauaaccuggagagccggauugagaaucucaacaagaagauggaagauggguuccuggacgucuggacguacaaugccgagcugcucgugcugauggaaaacgagcgcacccuugauuuccacgacuccaauguuaaaaaccuguaugauaaggugagacuccaacugcgggacaaugccaaagaacuuggaaacggcuguuuugaguucuaccauagaugcgauaaugaguguauggaaucuguccgcaacgggacauacgacuauccccaguacagcgaggaagcucggcugaagagagaggagaucuccggagugaaacucgaaagcauuggcaccuaucagauccugucuauuuacuccacagucgcgagcucucuggcccucgcuaucaugguggccgggcuguuucuuuggaugugcuccaauggcagccugcagugccgcauuuguaucuga

SEQ ID NO: 186012 - RNA, 1704 nt, Artificial Sequence
  derived and/or modified sequence opt5 from hemagglutinin__InfluenzaA__ACT15326
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcucuuucuuuagaaauguuguguggcucaccaaaaaggauaacgcuuaucccacaaucaaacgguccuacaauaacaccaaccaagaggaccugcuuguccuguggggcauucaccacccuaaugaugccgcugagcagacacgccucuaucagaacccgaccacguacaucagcgugggaaccucuacacugaaucagagacugauccccaagauugccacccgguccaaggugaacggccaaagcgggcgcauggaauuuuucuggacaauccucaaaccuaaugacgcgauuaacuuugagucuaauggaaacuucaucgcccccgaaaaugcuuacaagauugucaaaaagggcgauuccaccaucaugaaaagcgagcuggaauaugggaacugcaauacgaagugucagacaccuaucggagccauuaacuccucuaugcccuuucauaauauccacccgcuuaccauuggcgagugcccuaaauacguuaagagcaacagacuggugcucgcuacagggcugcggaauagcccccagggagagcgcagacggaagaaacgcggccuuuucggcgccaucgcgggguuuauugaaggaggcuggcaggggaugguggacggaugguauggcuaccaucacuccaacgagcaagggucuggauaugccgcugacaaggaauccacccagaaagccaucgauggcgucaccaacaaggugaauagcaucauugacaaaaugaacacacaguucgaggcuguuggcagagaauuuaauaaccuggagcggcgcaucgagaaucucaacaagaagauggaagauggguuccuggacguguggacguacaaugccgagcugcucguccugauggaaaacgagagaacccuugauuuccacgacucuaaugugaaaaaccuguaugauaagguucggcuccaacugagagacaaugccaaagaacuuggaaacggcuguuuugaguucuaccaucgcugcgauaaugaguguauggaaagcgugcggaacgggacauacgacuauccucaguacuccgaggaagcuagacugaagcgcgaggagauuucuggagucaaacucgaaagcaucggcaccuaucagauucuguccaucuacagcacaguggcgucuucccuggcccucgcuauuauggucgccgggcuguuucuuuggaugugcagcaauggcucucugcagugccggaucuguaucuga

SEQ ID NO: 186013 - RNA, 1704 nt, Artificial Sequence
  derived and/or modified sequence opt5 from hemagglutinin__InfluenzaA__ACT15328
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccgcugagcagacacgccucuaucagaacccgaccacguacaucagcgugggaaccucuacacugaaucagagacuggugcccaagaucgccacccgguccaaggucaacggccaaaaugggcgcauggaauuuuucuggacaauucucaaaagcaacgacgcgaucaauuuugagucuaacggaaauuucauugccccugaaaacgcuuacaagaucguuaaaaagggcgauuccaccauuaugaaaagcgagcuggaauaugggaauugcaacacgaagugucagacacccaucggagccaucaauuccucuaugccuuuucauaacauucacccccuuaccaucggcgagugcccgaaauacgugaaaagcaauagacuggugcucgcuacagggcugcggaacuccccucagggagagcgcagacggaagaaacgcggccuuuucggcgccauugcgggguuuaucgaaggaggcuggcaggggauggucgacggaugguauggcuaccaucacagcaacgagcaagggucuggauaugccgcugacaaggaauccacccagaaagccauugauggcgugaccaauaagguuaacagcaucaucgacaaaaugaauacacaguucgaggcugugggcagagaauuuaacaaucuggagcggcgcauugagaaccucaauaagaagauggaagauggguuccuggacgucuggacguacaacgccgagcugcucgugcugauggaaaaugagagaacccuugauuuccacgacucuaacguuaaaaaucuguaugauaaggugcggcuccaacugagagacaacgccaaagaacuuggaaauggcuguuuugaguucuaccaucgcugcgauaacgaguguauggaaagcguccggaaugggacauacgacuauccccacuacuccgaggaagcuagacugaagcgcgaggagaucucuggagugaaacucgaaagcauuggcaccuaucagauccuguccauuuacagcacagucgcgucuucccuggcccucgcuaucaugguggccgggcuguuucuuuggaugugcagcaacggcucucugcagugccggauuuguaucuga

SEQ ID NO: 186014 - RNA, 1704 nt, Artificial Sequence
  derived and/or modified sequence opt5 from hemagglutinin__InfluenzaA__ACT15330
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccgcugagcagacacgccucuaucagaacccgaccacguacaucagcgugggaaccucuacacugaaucagagacuggugcccaagaucgccacccgguccaaggucaacggccaaagcgggcgcauggaauuuuucuggacaauucucaaaucuaaugacgcgaucaacuuugaguccaauggaaacuucauugccccugaaaaugcuuacaagaucguuaaaaagggcgauagcaccauuaugaaauccgagcuggaauaugggaacugcaauacgaagugucagacacccaucggagccaucaacucuagcaugccuuuucauaauauucacccccuuaccaucggcgagugcccgaaauacgugaaguccaacagacuggugcucgcuacagggcugcggaauagcccucagggagagcgcagacggaagaaacgcggccuuuucggcgccauugcgggguuuaucgaaggaggcuggcaggggauggucgacggaugguauggcuaccaucacucuaacgagcaaggguccggauaugccgcugacaaggaaagcacccagaaagccauugauggcgugaccaacaagguuaauucuaucaucgacaaaaugaacacacaguucgaggcugugggcagagaauuuaauaaccuggagcggcgcauugagaaucucaacaagaagauggaagauggguuccuggacgucuggacguacaaugccgagcugcucgugcugauggaaaacgagagaacccuugauuuccacgacagcaauguuaaaaaccuguaugauaaggugcggcuccaacugagagacaaugccaaagaacuuggaaacggcuguuuugaguucuaccaucgcugcgauaaugaguguauggaauccguccggaacgggacauacgacuauccccacuacucugaggaagcuagacugaagcgcgaggagaucagcggagugaaacucgaauccauuggcaccuaucagauccugagcauuuacucuacagucgcguccagccuggcccucgcuaucaugguggccgggcuguuucuuuggaugugcucuaauggcucccugcagugccggauuuguaucuga

SEQ ID NO: 186015 - RNA, 1707 nt, Artificial Sequence
  derived and/or modified sequence opt5 from hemagglutinin__InfluenzaA__ACT15332
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugaccaugaagccagcuccggcgugagcucugccuguccuuaccaggggcgcuccagcuuuuucagaaacguuguguggcucaucaaaaaggauaaugcuuaucccaccauuaaacggucuuacaacaauacaaaccaagaggaccugcuuguccuguggggaauccaccacccuaaugaugccgcugagcagacccgccucuaucauaacccgacaaccuacaucuccgugggcacgagcacccugaaccagagacuggugcccaagauugccacacggucuaagaucaauggccaguccgggcgcauggaauuuuucuggaccauucucaaaccuaacgacgcgaucaauuuugagagcaacggaaauuucauugcccccgaaaacgcuuacaagaucgucaaaaagggcgacuccacaaucaugaaaucugagcuggaauaugggaauugcaacaccaagugucaaacgccuauuggagccaucaauagcuccaugcccuuucacaacauucauccgcuuacaaucggcgagugcccuaaauacguuaagagcucuagacuggugcucgcuaccgggcugcggaauagcccccagggaaagucccgccggaaaaagagaggccuuuucggcgccauugcgggguuuaucgagggaggcuggcaggggaugguggauggaugguauggcuaccaccacucuaacgaacaggggagcggauaugccgcugacaaagaguccacacaacgcgccaucgauggcgucaccaauaaggugaacucuauuaucgacaaaaugaauacccaguucgaagcuguuggcagagaguuuaacaaccuggaacggcgcauugagaaucucaacaagaagauggaggauggguuccuggacguguggacauacaaugccgaacugcucguccugauggagaacgaaagaacgcuugauuuccaugacagcaaugugaaaaaccuguaugauaagguucggcuccagcugagagacaaugccaaagagcuuggaaacggcuguuuugaguucuaccaccgcugcgauaaugaauguauggaguccgugcggaacgggaccuacgacuauccucaauacagcgaagaggcuagacugaagcgcgaagagaucucuggagucaaacucgaguccauuggcaucuaucagauucugagcaucuacucuacaguggcguccagccuggcccucgcuaucauggucgccgggcuguuucuuuggaugugcuccaauggcucucugcagugccggauuuguaucuga

SEQ ID NO: 186016 - RNA, 1704 nt, Artificial Sequence
  derived and/or modified sequence opt5 from hemagglutinin__InfluenzaA__ACT15336
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccgcugagcagacacgccucuaucagaacccgaccacguacaucagcgugggaaccucuacacugaaucagagacuggugcccaagaucgccacccgguccaaggucaacggccaaagcgggcgcauggaauuuuucuggacaauucucaaaucuaaugacgcgaucaacuuugaguccaauggaaacuucauugccccugaaaaugcuuacaagaucguuaaaaagggcgauagcaccauuaugaaauccgagcuggaauaugggaacugcaauacgaagugucagacacccaucggagccaucaacucuagcaugccuuuucauaauauucacccccuuaccaucggcgagugcccgaaauacgugaaguccaacagacuggugcucgcuacagggcugcggaauagcccucagggagagcgcagacggaagaaacgcggccuuuucggcgccauugcgggguuuaucgaaggaggcuggcaggggauggucgacggaugguauggcuaccaucacucuaacgagcaaggguccggauaugccgcugacaaggaaagcacccagaaagccauugauggcgugaccaacaagguuaauucuaucaucgacaaaaugaacacacaguucgaggcugugggcagagaauuuaauaaccuggagcggcgcauugagaaucucaacaagaagauggaagauggguuccuggacgucuggacguacaaugccgagcugcucgugcugauggaaaacgagagaacccuugauuuccacgacagcaauguuaaaaaccuguaugauaaggugcggcuccaacugagagacaaugccaaagaacuuggaaacggcuguuuugaguucuaccaucgcugcgauaaugaguguauggaauccguccggaacgggacauacgacuauccccaguacucugaggaagcuagacugaagcgcgaggagaucagcggagugaaacucgaauccauuggcaccuaucagauccugagcauuuacucuacagucgcguccagccuggcccucgcuaucaugguggccgggcuguuucuuuggaugugcucuaauggcucccugcagugccggauuuguaucuga

SEQ ID NO: 186017 - RNA, 1704 nt, Artificial Sequence
  derived and/or modified sequence opt5 from hemagglutinin__InfluenzaA__ACT15338
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaagaacaaugcuuaucccacaaucaaacggucuuacaacaacaccaaucaagaggaucugcuuguccuguggggcauucaccacccuaacgacgccacagagcagacccgccucuaucagaauccgacgaccuacaucagcgugggaacaucuacccugaaccagagacugauccccaagauugcuacacgguccaaggugaauggccaaagcgggcgcauggaauuuuucuggaccauccucaaaucuaacgaugccauuaauuuugaguccaacggaaauuucaucgcgccugaaaacgccuacaagauugucaaaaagggcgacagcacgaucaugaaauccgagcuggaauaugggaauugcaacacaaagugucagacccccaucggagcuauuaauucuagcaugccuuuucauaacauccacccccuuacaauuggcgagugcccgaaauacguuaaguccaauagacuggugcucgccaccgggcugcggaacagcccucaggagggacgcagacggaagaaacgcggccuuuucggcgcuaucgccggguuuauugaaggaggcuggcaggggaugguggauggaugguauggcuaccaucacucuaacgagcaaggguccggauaugcggccgacaaggaaagcacccagaaagcuaucgacggcgucacaaauaaggugaacucuaucauugauaaaaugaauacgcaguucgaggccguuggcagagaauuuaacaaucuggagcggcgcaucgagaaccucaauaagaagauggaagacggguuccuggauguguggaccuacaacgcugagcugcucguccugauggaaaaugagagaacacuugacuuccacgauagcaacgugaaaaaucuguaugacaagguucggcuccaacugagagauaacgccaaagaacuuggaaauggcuguuuugaguucuaccaucgcugcgacaacgaguguauggaauccgugcggaaugggaccuacgauuauccccaguacucugaggaagccagacugaagcgcgaggagauuagcggagucaaacucgaauccaucggcacauaucagauucugagcaucuacucuaccguggcuuccagccuggcgcucgccauuauggucgcugggcuguuucuuuggaugugcucuaacggcucccugcagugccggaucuguaucuga

SEQ ID NO: 186018 - RNA, 1704 nt, Artificial Sequence
  derived and/or modified sequence opt5 from hemagglutinin__InfluenzaA__ACT15340
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaagaacaaugcuuaucccacaaucaaacggucuuacaacaacaccaaucaagaggaucugcuuguccuguggggcauucaccacccuaacgacgccgaggaacagacacgccucuaucagaauccgaccacguacaucagcgugggaaccucuacacugaaccagagacuggugcccaagaucgcuacccgguccaaggucaauggccaaagcgggcgcauggaguuuuucuggacaauucucaaaucuaacgaugccaucaauuuugaauccaacggaaauuucauugcgccugagaacgccuacaagaucguuaaaaagggcgacagcaccauuaugaaauccgaacuggaguaugggaauugcaacacgaagugucagacacccaucggagcuaucaauucuagcaugccuuuucauaacauucacccccuuaccaucggcgagugcccgaaauacgugaaguccaauagacuggugcucgccacagggcugcggaacagcccucagggagaacgcagacggaagaaacgcggccuuuucggcgcuauugccggguuuaucgagggaggcuggcaggggauggucgauggaugguauggcuaccaucacucuaacgaacaaggguccggauaugcggccgacaaggagagcacccagaaagcuauugacggcgugaccaauaagguuaacucuaucaucgauaaaaugaauacacaguucgaagccgugggcagagaguuuaacgcucuggagcggcgcauugaaaaucucaacaagaagauggaggacggguuccuggaugucuggacguacaaugccgaacugcucgugcugauggagaacgaaagaacccuugacuuccacgauagcaauguuaaaaaccuguaugacaaggugcggcuccaacugagagauaaugccaaagagcuuggaaacggcuguuuugaguucuaccaucgcugcgacaaugaauguauggaguccguccggaacgggacauacgauuauccccaguacucugaagaggcuagacugaagcgcgaggaaaucagcggagugaaacucgaguccauuggcaccuaucagauccugagcauuuacucuacagucgcguccagccuggcccucgcuaucaugguggccgggcuguuucuuuggaugugcucuaauggcucccugcagugccggauuuguaucuga

SEQ ID NO: 186019 - RNA, 1704 nt, Artificial Sequence
  derived and/or modified sequence opt5 from hemagglutinin__InfluenzaA__ACT15342
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaucuuuuaaugauuaugaggaacugaagcaucuucugagccggaucaaccacuucgagaaaauucagaucauucccaaaaauuccuggucugaccaugaagccagcggcguguccagcgccuguccuuaccaggggagaucuuccuuuuuccgcaacguuguguggcucaccaaaaaggauaaugcuuaucccacaaucaaacggagcuacaacaauaccaaccaagaggaccugcuuguccuguggggcauucaccacccuaacgaugccgcugagcagacacgccucuaucagaauccgaccacguacaucucugugggaaccuccacacugaaccagagacuggugcccaagaucgccacccggagcaaggucaauggccaaucugggcgcauggaauuuuucuggacaauucucaaaccuaacgacgcgaucaauuuugaguccaacggaaauuucauugcccccgaaaacgcuuacaagaucguuaaaaagggcgauagcaccauuaugaaauccgagcuggaauaugggaauugcaacacgaagugucagacaccuaucggagccaucaauucuagcaugcccuuucauaacauucacccgcuuaccaucggcgagugcccuaaauacgugaaguccaauagacugauucucgcuacagggcugcggaacagcccccagggagagcgcagacggaagaaacgcggccuuuucggcgccaucgcgggguuuauugaaggaggcuggcaggggaugguggacggaugguauggcuaccaucacucuaaugagcaaggguccggauaugccgcugacaaggaaagcacccagaaagccaucgauggcgucaccaacaaggugaacucuaucauugacaaaaugaauacacaguucgaggcuguuggcagagaauuuaacaaucuggagcggcgcaucgagaaccucaauaagaagauggaagauggguuccuggacguguggacguacaacgccgagcugcucguccugauggaaaaugagagaacccuugauuuccacgacagcaacgugaaaaaucuguaugauaagguucggcuccaacugagagacaacgccaaagaacuuggaaauggcuguuuugaguucuaccaucgcugcgauaacgaguguauggaauccgugcggaaugggacauacgacuauccucaguacucugaggaagcuagacugaagcgcgaggagauuagcggagucaaacucgaauccaucggcaccuaucagauucugagcaucuacucuacaguggcguccagccuggcccucgcuauuauggucgccgggcuguuucuuuggaugugcucuaacggcucccugcagugccggaucuguaucuga

SEQ ID NO: 186020 - RNA, 1704 nt, Artificial Sequence; identical to SEQ ID NO: 186016
  derived and/or modified sequence opt5 from hemagglutinin__InfluenzaA__ACT15343

SEQ ID NO: 186021 - RNA, 1704 nt, Artificial Sequence
  derived and/or modified sequence opt5 from hemagglutinin__InfluenzaA__ACT15345
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccagcuguccuuaccaggggcggucuuccuuuuucagaaauguuguguggcucaccaaaaaggauaacgccuaucccacaaucaaacggagcuacaauaacaccaaccaagaggaccugcuuguccuguggggcauucaccacccuaaugaugcugccgagcagacacgccucuaucagaacccgaccacguacaucucugugggaaccuccacacugaaucagagacuggugcccaagaucgcuacccggagcaaggucaacggccaaucugggcgcauggaauuuuucuggacaauucucaaauccaaugacgccaucaacuuuggaagcaauggcaacuucauugcgccugagaaugccuacaagaucguuaaaaagggggauuccaccauuaugaaaucugaacuggaguauggaaacugcaauacgaagugucagacacccaucggcgcuaucaacagcuccaugccuuuucauaauauucacccccuuaccaucggggaaugcccgaaauacgugaaaagcaacagacuggugcucgccacaggacugcgcaauucuccucagggcgagcgcagacggaagaaacgcggccuuuucggggcuauugccggauuuaucgagggcggguggcagggaauggucgacggcugguauggguaccaucacuccaacgaacaaggaagcggcuaugcggccgacaaggagucuacccagaaagcuauugauggcgugaccaacaagguuaauagcaucaucgacaaaaugaacacacaguucgaagccguggggagagaguuuaauaaccuggaacggcgcauugagaaucucaacaagaagauggaggauggauuccuggacgucuggacguacaaugcugaacugcucgugcugauggagaacgaaagaacccuugauuuccacgacuccaauguuaaaaaccuguaugauaaggugcggcuccaacugagagacaaugccaaagagcuuggcaacggguguuuugaguucuaccaucgcugcgauaaugaauguauggagucuguccggaacggaacauacgacuauccccaguacagcgaagaggccagacugaagcgcgaagagaucuccggcgugaaacucgagagcauugggaccuaucagauccugucuauuuacuccacagucgcuagcucucuggcgcucgccaucaugguggcuggccuguuucuuuggaugugcuccaauggaagccugcagugccggauuuguaucuga

SEQ ID NO: 186022 - RNA, 1707 nt, Artificial Sequence
  derived and/or modified sequence opt5 from hemagglutinin__InfluenzaA__ACT15347
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugaccaugaagccagcuccggcgugagcucugccuguccuuaccaggggcgcuccagcuuuuucagaaacguuguguggcucaucaaaaaggauaaugcuuaucccaccauuaaacggucuuacaacaauacaaaccaagaggaccugcuuguccuguggggaauccaccacccuaaugaugccgcugagcagacccgccucuaucauaacccgacaaccuacaucuccgugggcacgagcacccugaaccagagacuggugcccaagauugccacacggucuaaggucaauggccaguccgggcgcauggaauuuuucuggaccauccucaaaccuaacgacgcgauuaauuuugagagcaacggaaauuucaucgcccccgaaaacgcuuacaagauuguuaaaaagggcgacuccacaaucaugaaaucugagcuggaauaugggaauugcaacaccaagugucaaacgccuaucggagccauuaauagcuccaugcccuuucacaacauccauccgcuuacaauuggcgagugcccuaaauacgugaaaagcucuagacuggugcucgcuaccgggcugcggaauagcccccagggaaagaaccgccggaaaaagagaggccuuuucggcgccaucgcgggguuuauugagggaggcuggcaggggauggucgauggaugguauggcuaccaccacuccaaugaacaggggucuggauaugccgcugacaaagagagcacacaacgcgccaucgauggcgugaccaacaagguuaauuccaucauugacaaaaugaacacccaguucgaagcugugggcagagaguuuaacaaucuggaacggcgcaucgagaaccucaauaagaagauggaggauggguuccuggacgucuggacauacaacgccgaacugcucgugcugauggagaaugaaagaacgcuugauuuccaugacucuaacguuaaaaaucuguaugauaaggugcggcuccagcugagagacaacgccaaagagcuuggaaauggcuguuuugaguucuaccaccgcugcgauaacgaauguauggagagcguccggaaugggaccuacgacuauccucaauacuccgaagaggcuagacugaagcgcgaagagauuagcggagugaaacucgagucuaucggcauuuaucagauccuguccauuuacagcacagucgcgucuucccuggcccucgcuaucaugguggccgggcuguuucuuuggaugugcagcaacggcucccugcagugccggaucuguauuuga

SEQ ID NO: 186023 - RNA, 1704 nt, Artificial Sequence
  derived and/or modified sequence opt5 from hemagglutinin__InfluenzaA__ACT15349
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggagaaaacacacaaugggaagcucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaaggauaacgcuuaucccacaaucaaacggucuuacaauaacaccaaccaagaggaccugcuuguccuguggggcauucaccacccuaaugaugccacagagcagacccgccucuaucagaacccgacgaccuacaucagcgugggaacaucuacccugaaucagagacugauccccaagauugcuacacgguccaaggugaacggccaaagcgggcgcauggaauuuuucuggaccauccucaaaucuaaugacgccauuaacuuugaguccaauggaaacuucaucgcgccugaaaaugccuacaagauugucaaaaagggcgauagcacgaucaugaaauccgagcuggaauaugggaacugcaauacaaagugucagacccccaucggagcuauuaacucuagcaugccuuuucauaauauccacccccuuacaauuggcgagugcccgaaauacguuaaguccaacagacuggugcucgccaccgggcugcggaauagcccucaggaggaacgcagacggaagaaacgcggacuuuucggcgcuaucgccggcuuuauugaagggggauggcagggcaugguggacgggugguauggauaccaucacucuaacgaacaaggcuccggguaugcggccgacaaggagagcacccagaaagcuaucgauggagucacaaacaagguuaauucuaucauugacaaaaugaacacgcaguucgaagccgugggcagagaguuuaauaaccuggagcggcgcaucgaaaaucucaacaagaagauggaggauggcuuccuggacguguggaccuacaaugcugaacugcucguccugauggagaacgaaagaacacuugauuuccacgacagcaaugugaaaaaccuguaugauaagguucggcuccaacugagagacaaugccaaagagcuugggaacggauguuuugaguucuaccaucgcugcgauaaugaauguauggaguccgugcggaacggcaccuacgacuauccccaguacucugaagaggccagacugaagcgcgaggaaauuagcggggucaaacucgaguccaucggaacauaucagauucugagcaucuacucuaccguggcuuccagccuggcgcucgccauuauggucgcuggccuguuucuuuggaugugcucuaaugggucccugcagugccggaucuguaucuga

SEQ ID NO: 186024 - RNA, 1707 nt, Artificial Sequence
  derived and/or modified sequence opt5 from hemagglutinin__InfluenzaA__ACT15351
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugaccaugaagccagcuccggcgugagcucugccuguccuuaccaagggggauccagcuuuuuccgcaacguuguguggcucaucaaaaaggauaaugcuuaucccaccauuaaaagaucuuacaacaauacaaaccaggaggaccugcuuguccuguggggcauccaccacccuaaugaugccgcugagcagacccggcucuaucauaacccgacaaccuacaucuccgugggcacgagcacccugaaccagcgccuggugcccaagauugccacaagaucuaaggucaaugggcaguccggacggauggaauuuuucuggaccauccucaaaccuaacgacgcgauuaauuuugagagcaacggcaauuucaucgcccccgaaaacgcuuacaagauuguuaaaaagggggacuccacaaucaugaaaucugagcuggaauauggaaauugcaacaccaagugucaaacgccuaucggcgccauuaauagcuccaugcccuuucacaacauccauccgcuuacaauuggggagugcccuaaauacgugaaaagcucucgccuggugcucgcuaccggacugagaaauagcccccagggcaagucccggcgcaaaaagagaggccuuuucggggccaucgcgggauuuauugagggcggguggcagggaauggucgauggcugguauggguaccaccacucuaacgaacagggaagcggcuaugccgcugacaaagaguccacacaacgggccaucgauggcgugaccaauaagguuaacucuaucauugacaaaaugaauacccaguucgaagcuguggggcgcgaguuuaacaagcuggaaagacggaucgagaaccucaauaagaaaauggaggauggauuccuggacgucuggacauacaacgccgaacugcucgugcugauggagaaugaacgcacgcuugauuuccaugacagcaacguuaagaaucuguaugauaaagugagacuccagcugcgggacaacgccaaggagcuuggcaauggguguuuugaguucuaccacagaugcgauaacgaauguauggaguccguccgcaauggaaccuacgacuauccucaauacagcgaagaggcucggcugaaaagagaagagauuucuggcgugaagcucgaguccaucgggauuuaucagauccugagcauuuacucuacagucgcguccagccuggcccucgcuaucaugguggccggccuguuucuuuggaugugcuccaacggaucucugcagugccgcaucuguauuuga

SEQ ID NO: 186025 - RNA, 1704 nt, Artificial Sequence
  derived and/or modified sequence opt5 from hemagglutinin__InfluenzaA__ACT15353
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaaacucuguaaccuggauggagugaaaccccuuauccugagagacugcagcguugcgggcuggcuccuggggaauccuaugugugaugaguuccugaacgugccggaaugguccuauaucgucgagaagauuaaucccgcuaacgaccucugcuacccuggaaauuuuaacgauuaugaggaacugaagcaucuucugucucggaucaaucacuucgagaaaauucagaucauucccaagaacagcugguccgaccaugaagccucuggcgugagcuccgccuguccuuaccaggggcgcagcuccuuuuucagaaauguuguguggcucaccaaaaagaacucugcuuaucccacaaucaaacggagcuacaauaacaccaaccaagaggaucugcuuguccuguggggcauucaccacccuaaugacgccgcugagcagacacgccucuaucagaacccgaccacguacaucucugugggaaccuccacacugaaucagagacuggugcccaagaucgccacccggagcaaggucaacggccaaucugggcgcauggaauuuuucuggacaauucucaaauccaaugaugcgaucaacuuugagagcaauggaaacuucauugccccugaaaaugcuuacaagaucguuaaaaagggcgacuccaccauuaugaaaucugagcuggaauauagcaacugcaauacgaagugucagacacccaucggggccaucaacuccagcaugccuuuucauaauauucacccccuuaccaucggagagugcccgaaauacgugaagucuaacagacuggugcucgcuacaggccugcgcaauuccccucagggggagcggagacggaagaaacgcggacuuuucggcgccauugcgggcuuuaucgaagggggauggcagggcauggucgaugggugguauggauaccaucacagcaacgagcaaggcucuggguaugccgcugacaaggaaagcacccagaaagccauugacggagugaccaacaagguuaauuccaucaucgauaaaaugaacacacaguucgaggcugugggcagagaauuuaauaaccuggagcggcgcauugagaaucucaacaagaagauggaagacggcuuccuggaugucuggacguacaaugccgagcugcucgugcugauggaaaacgagagaacccuugacuuccacgauucuaauguuaaaaaccuguaugacaaggugcggcuccaacugagagauaaugccaaagaacuugggaacggauguuuugaguucuaccaucgcugcgacaaugaguguauggaaagcguccggaacggcacauacgauuauccccaguacuccgaggaagcuagacugaagcgcgaggagaucagcggggugaaacucgaaucuauuggaaccuaucagauccuguccauuuacagcacagucgcgucuucccuggcccucgcuaucaugguggccggccuguuucuuuggaugugcagcaaugggucccugcagugccggauuuguaucuga

SEQ ID NO: 186026 - RNA, 1707 nt, Artificial Sequence
  derived and/or modified sequence opt5 from hemagglutinin__InfluenzaA__ACT15355
auggagaagaucgugcugcuccuggccauugucagccuuguuaaauccgaccagaucugcauuggcuaccacgcuaacaauucuaccgaacaaguggauacaaucauggagaagaacgugacggucacccaugcccaggacauucuggaaaagacacacaaugggaagcucugugaucuggacggagugaaaccccuuauccugagagauugcagcguugcgggcuggcuccuggggaacccuaugugugacgaguuccugaaugugccggaaugguccuauaucgucgagaagauuaaccccgcuaaugaucucugcuacccuggagacuuuaacgauuaugaggaacugaagcaucuucugucucggaucaaucacuucgagaaaauucagaucauucccaagagcuccuggucugaccaugaagccagcuccggcgugagcucugccuguccuuaccaggggcgcuccagcuuuuucagaaacguuguguggcucaucaaaaaggauaaugcuuaucccaccauuaaacggucuuacaacaauacaaaccaagaggaccugcuuguccuguggggaauccaccacccuaaugaugccgcugagcagacccgccucuaucauaacccgacaaccuacaucuccgugggcacgagcacccugaaccagagacuggugcccaagauugccacacggucuaaggucaauggccaguccgggcgcauggaauuuuucuggaccauccucaaaccuaacgacgcgauuaauuuugagagcaacggaaauuucaucgcccccgaaaacgcuuacaagauuguuaaaaagggcgacuccacaaucaugaaaucugagcuggaauaugggaauugcaacaccaagugucaaacgccuaucggagccauuaauagcuccaugcccuuucacaacauccauccgcuuacaauuggcgagugcccuaaauacgugaaaagcucuagacuggugcucgcuaccgggcugcggaauagcccccagggaaagucccgccggaaaaagagaggccuuuucggcgccaucgcgggguuuauugagggaggcuggcaggggauggucgauggaugguauggcuaccaccacucuaacgaacaggggagcggauaugccgcugacaaagaguccacacaacgcgccaucgauggcgugaccaauaagguuaacucuaucauugacaaaaugaauacccaguucgaagcugugggcagagaguuuaacaaccuggaacggcgcaucgagaaucucaacaagaagauggaggauggguuccuggacgucuggacauacaaugccgaacugcucgugcugauggagaacgaaagaacgcuugauuuccaugacagcaauguuaaaaaccuguaugauaaggugcggcuccagcugagagacaaugccaaagagcuuggaaacggcuguuuugaguucuaccaccgcugcgauaaugaauguauggaguccguccggaacgggaccuacgacuauccucaauacagcgaagaggcuagacugaagcgcgaagagauuucuggagugaaacucgaguccaucggcauuuaucagauccugagcauuuacucuacagucgcguccagccuggcccucgcuaucaugguggccgggcuguuucuuuggaugugcuccaauggcucucugcagugccggaucuguauuuga

SEQ ID NO: 186027 - RNA, 1704 nt, Artificial Sequence
  derived and/or modified sequence opt5 from hemagglutinin__InfluenzaA__ACT15357
auggagaagaucgugcugcuccuggccauugucagccuuguuaaauccgaccagaucugcauuggcuaccacgcuaacaauucuaccgaacaaguggauacaaucauggagagaaacgugacggucacccaugcccaggacauucuggaaaagacacacaaugggaaacucuguaaccuggauggagugaagccccuuauccugcgggacugcagcguugcgggcuggcuccuggggaauccuaugugugaugaguuccugaacgugccggaaugguccuauaucgucgagaaaauuaaucccgcuaacgaccucugcuacccuggaaauuuuaacgauuaugaggaacugaagcaucuucugucucgcaucaaucacuucgagaagauucagaucauucccaaaaacagcugguccgaccaugaagccucuggcgugagcuccgccuguccuuaccaggggagaagcuccuuuuuccggaauguuguguggcucacccaaaaggauaacgcuuaucccacaaucaaacgcucuuacaauaacaccaaccaggaggaccugcuuguccuguggggcauucaccacccuaaugaugccgcugagcagacaagacucuaucagaacccgaccacguacaucagcgugggaaccucuacacugaaucaacggcugauccccaagauugccacccgcuccaaagugaacggccagagcgggagaauggaauuuuucuggacaauccucaagucuaaugacgcgauuaacuuugaguccaauggaaacuucaucgccccugaaaaugcuuacaagauugucaaaaagggcgauagcaccaucaugaaauccgagcuggaauaugggaacugcaauacgaagugucagacacccaucggagccauuaacucuagcaugccuuuucauaauauccacccccuuaccauuggcgagugcccgaaauacguuaaguccaaccggcuggugcucgcuacagggcugcgcaauagcccucagggagagagacggcgcaaaaagagaggccuuuucggcgccaucgcgggguuuauugaaggaggcuggcaagggaugguggacggaugguauggcuaccaucacucuaacgagcagggguccggauaugccgcugacaaggaaagcacccagaaagccaucgauggcgucaccaacaagguuaauucuaucauugacaaaaugaacacacaauucgaggcugugggccgggaauuuaauaaccuggagcgcagaaucgagaaucucaacaagaaaauggaagauggguuccuggacguguggacguacaaugccgagcugcucguccugauggaaaacgagcggacccuugauuuccacgacagcaaugugaagaaccuguaugauaagguuagacuccagcugcgcgacaaugccaaagaacuuggaaacggcuguuuugaguucuaccaucggugcgauaaugaguguauggaauccgugagaaacgggacauacgacuauccccaguacucugaggaagcucgccugaagcgggaggagauuagcggagucaaacucgaauccaucggcaccuaucagauucugagcaucuacucuacaguggcguccagccuggcccucgcuauuauggucgccgggcuguuucuuuggaugugcucuaauggcucccugcaaugcagaaucuguaucuga

SEQ ID NO: 186028 - RNA, 1701 nt, Artificial Sequence
  derived and/or modified sequence opt5 from hemagglutinin__InfluenzaA__ACT20200
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcaaccagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 186029 - RNA, 1701 nt, Artificial Sequence
  derived and/or modified sequence opt5 from hemagglutinin__InfluenzaA__ACT21466
augaagaccaucauugcccugagcuacauccucugccugguguucgcucagaaacuucccggcaacgacaauuccacagccacgccuugucuggggcaccaugcggucccgaacggaacccucguuaagacaauuaccaaugaucaaaucgaggugacaaacgcuaccgaacuggugcagucuagcuccacaggcaaaauuugcgacucuccccacagaauccuugaugggaagaauuguacccugaucgacgcccuccugggagauccucauugcgacggcuuuaaaaacaaggagugggaucuguucgucgaacggagcacggccuauuccaauuguuaccccuaugacgugccugauuacgcuucucuccgcagccugguugccuccagcgggacccuugaguuuacaaacgaaggauucaauuggaccggcguggcucaggacggcacaucuuaugccugcaagagaggguccgucaagagcuuuuucucucggcugaacuggcuccacaaacuggaguacaaauaucccgcgcuuaaugugaccaugccuaacaaugauaaguuugacaaacuguacauuuggggaguucaucacccguccacggauagcgaccagacaucucucuacgugcaagccuccggccgcgucaccgugagcacaaagagaucccagcagaccgugauccccaacauugggucucggccuuggguccgcggaaucagcuccagaauuagcaucuauuggaccauuguuaagcccggcgacauccugcugaucaauucuacagggaaccucauugcuccucggggauacuucaaaauccgcuccggcaagagcucuauuaugagaagcgaugcccccaucgacaacuguaauuccgagugcauuacgccgaacggcucuaucccuaaugauaaacccuuucagaacgugaaucggaucaccuauggggcuuguccucgcuacgugaagcaaaacacacugaaacuugccaccggaaugagaaauguccccgaaaagcagacacggggcauuuucggggcgaucgccggauuuauugagaacggcugggaagggaugguggacggaugguauggcuuccgccaccagaauagcgagggcaccgggcaggcugccgaucugaaauccacgcaagcugccaucaaccagauuaauggaaagcucaacagacugaucgagaagacaaaugaaaaauuucaucagaucgagaaggaguucagcgaaguugaaggccggauucaagaccuugagaaauacguggaggauaccaagaucgaccuguggucuuauaacgccgaacuccuggucgcucuggagaaucagcacaccauugaucucacagacuccgaaaugaacaaacuguucgagaagaccagaaagcagcuucgcgaaaacgcggaggauauggggaauggaugcuuuaaaaucuaccauaagugugacaacgccugcauuggcagcauccggaaugggacauacgaccacgauguguauagagacgaggcucugaacaaucgcuuccagauuaaaggcguugaacucaagucuggauacaaagauuggauccuguggaucuccuuugccauuagcugcuuccuucugugugugguccuccugggcuuuaucaugugggccugccaaaaggggaacauucgguguaauaucugcauuuga

SEQ ID NO: 186030 - RNA, 1701 nt, Artificial Sequence
  derived and/or modified sequence opt5 from hemagglutinin__InfluenzaA__ACT21467
augaagaccaucauugcccugagcuacauccucugccugguguucgcucagaaacuucccggcuccgacaacucuacagccacgcugugucucgggcaccaugcggucccuaauggaacccugguuaagacaauuaccaacgaucaaaucgaggugacaaaugcuaccgaacuugugcagagcuccucuacaggcaaaauuugcgacagcccgcacagaauccuggaugggaagaacuguacccucaucgacgcccugcugggagauccccauugcgacggcuuuaaaaauaaggagugggaucucuucgucgaacgguccacggccuauucuaacuguuacccuuaugacgugcccgauuacgcuagccugcgcucccuuguugccagcucugggacccuggaguuuacaaaugaaggauucaacuggaccggcguggcucaggacggcacauccuaugccugcaagagagggagcgucaaaucuuucuucucccggcucaauuggcugcacaaacuugaguacaaguauccugcgcugaacgugaccaugcccaauaacgauaaguuugacaaacucuacauuuggggaguucaucacccuagcacggauucugaccagacaucccuguacgugcaagccagcggccgcgucaccguguccacaaagagaucucagcagaccgugaucccgaauauugggagccggcccuggguccgcggaaucuccagcagaauuucuguuuauuggaccaucgugaagccucgggacauucugcucaucaacuccacaggcaaucugaucgcuccccgcggguacuucaaaauuagaagcggaaagucuagcaucaugcgguccgaugccccuauugacaacuguaacucugagugcaucacgcccaauggcagcauuccgaacgauaaaccuuuucagaaugugaaccgcaucaccuauggcgcuugucccagauacgucaagcaaaauacacuuaaacuggccaccgggaugcggaacgugccugaaaagcagacacgcggaaucuucggcgcgauugccggguuuaucgagaauggaugggaaggcaugguugacgggugguauggauucagacaccagaacuccgagggcaccggccaggcugccgaucucaaaagcacgcaagcugccauuaaucggaucaacgggaagcugaauagacuuauugagaagacaaacgaaaaauuucaucagaucgagaaggaauuuucugagguggaaggacgcauccaggaccuggagaaauacgucgaggauaccaagauugaccucugguccuauaaugccgaacugcugguggcucucgagaaccaacacaccaucgaucugacagacagcgaaaugaauaaacuuuucgagaagacccggaagcagcugagagaaaacgcggaggauaugggcaacgggugcuuuaaaauuuaccauaagugugacaaugccugcaucggaucuauucgcaacggcacauacgaccacgauguuuaucgggacgaggcucucaauaacagauuccagaucaaagggguggaacugaaguccggcuacaaagauuggauucuuuggaucagcuuugccaucuccugcuuccugcucugugucgugcugcugggauuuauuaugugggccugccagaagggcaauauccgcuguaacauuugcaucuga

SEQ ID NO: 186031 - RNA, 1701 nt, Artificial Sequence
  derived and/or modified sequence opt5 from hemagglutinin__InfluenzaA__ACT21468
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcaaaauuugcgacucuccgcacagaauccuggaugggaagaauuguacccucaucgacgcccugcugggagauccccauugcgacggcuuuaaaaacaaggagugggaucucuucgucgaacggagcacggccuauuccaauuguuacccuuaugacgugcccgauuacgcuucucugcgcagccuuguugccuccagcgggacccuggaguuuacaaacgaaggauucaauuggaccggcguggcucaggacggcacaucuuaugccugcaagagaggguccgucaagagcuuuuucucucggcucaacuggcugcacaaacuugaguacaaauauccugcgcugaaugugaccaugcccaacaaugauaaguuugacaaacucuacauuuggggaguucaucacccuuccacggauagcgaccagacaucucuguacgugcaagccuccggccgcgucaccgugagcacaaagagaucccagcagaccgugaucccgaacauugggucucggcccuggguccgcggaaucagcuccagaauuagcaucuauuggaccauuguuaagccuggcgacauccugcucaucaauucuacagggaaccugauugcuccccggggauacuucaaaauccgcuccggcaagagcucuauuaugagaagcgaugccccuaucgacaacuguaauuccgagugcauuacgcccaacggcucuaucccgaaugauaaaccuuuucagaacgugaaucggaucaccuauggggcuuguccccgcuacgugaagcaaaacacacuuaaacuggccaccggaaugagaaaugucccugaaaagcagacacggggcauuuucggggcgaucgccggauuuauugagaacggcugggaagggaugguggacggaugguauggcuuccgccaccagaauagcgagggcaccgggcaggcugccgaucucaaauccacgcaagcugccaucaaccagauuaauggaaagcugaacagacuuaucgagaagacaaaugaaaaauuucaucagaucgagaaggaguucagcgaaguugaaggccggauucaagaccuggagaaauacguggaggauaccaagaucgaccucuggucuuauaacgccgaacugcuggucgcucucgagaaucagcacaccauugaucugacagacuccgaaaugaacaaacuuuucgagaagaccagaaagcagcugcgcgaaaacguggaggauauggggaauggaugcuuuaaaaucuaccauaagugugacaacgcgugcauuggcagcauccggaaugggacauacgaccacgauguuuauagagacgaggcccucaacaaucgcuuccagauuaaaggcguggaacugaagucuggauacaaagauuggauccuuuggaucuccuuugcuauuagcugcuuccugcucugugucgugcugcugggcuuuaucaugugggccugccaaaaggggaacauucgguguaauaucugcauuuga

SEQ ID NO: 186032 - RNA, 1701 nt, Artificial Sequence
  derived and/or modified sequence opt5 from hemagglutinin__InfluenzaA__ACT21469
augaagaccaucauugcccugagcuacaucuccagacucguguucgcucagaaacugcccggcaacgacaauucuacagccacgcuuugccuggggcaccaugcggucccuaacggaacccucguuaagacaauuaccaaugaucaaaucgaggugacaaacgcuaccgaacuggugcagagcuccucuacaggccggauuugugacagcccgcaccgcauccuugauggggagaauugcacccugaucgacgcccuccugggagauccccauugugacggcuuucagaacaaagaaugggaucuguucgucgagagauccaaggccuauucuaauugcuacccuuaugacgugcccgauuacgcuagccuccggucccugguugccagcucugggacgcuugaauuuaacaaugaguccuucaacuggaccggaguggcucaggacggcacaagcuaugccuguaaacgcagaucuauuaaguccuuuuucagccggcugaauuggcuccaccaacugaaguacaaauauccugcgcuuaacgucaccaugcccaauaacgauaaguuugacaaacuguacaucuggggcgugcaucacccuucuacagauuccgaccagaccagccucuacgcccaggcuuccgggcgcguuacggugucuacaaagagaagccagcaaaccgucauuccgaauaucggaucccggcccugggugcgcggcgugagcucuagaauuuccaucuauuggacaauugucaaaccuggggacauccugcugaucaacagcaccggaaaccucauugcuccccggggcuacuucaagauccgcucuggaaagagcuccauuaugagaucugaugccccuaucgggaaaugcaauagcgaguguauuacccccaacggcuccaucccgaaugacaagccuuuucagaacguuaaucggaucacauauggcgccugcccccgcuacgugaaacagaacacgcugaaacuugcgaccgggaugagaaaugugccugaaaagcagacacggggaauuuucggcgccaucgcuggguuuauugagaacggaugggaaggcauggucgaugggugguauggauucagacaccaaaauagcgagggcaccggccaggccgcugaccugaagucuacacaggccgccaucaaccaaauuaaugggaaacucaaccgccugaucgagaagaccaaugaaaaguuucaucagaucgagaaagaguucuccgaaguggaaggacggauucaggaucuugagaaguacguugaggacacgaaaaucgaucuguggagcuauaacgcugaacuccugguggcgcuggagaaucagcacacaauugaccucaccgauucugaaaugaacaagcuguucgagagaacccgcaaacaacuucgggaaaacgccgaggacaugggcaauggguguuuuaagaucuaccauaagugcgauaacgcuuguauuggauccaucagaaauggcacauacgaccacgacgucuaucgcgaugaggcccugaacaaucgguuccagauuaaagggguggaacucaagagcggcuacaaagacuggauccuguggaucuccuuugccauuucuugcuuccuucugugcguugugcuccugggauuuaucaugugggcuugucagaagggcaacauuagaugcaauaucuguauuuga

SEQ ID NO: 186033 - RNA, 1701 nt, Artificial Sequence
  derived and/or modified sequence opt5 from hemagglutinin__InfluenzaA__ACT21471
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucaggacggcacaagcuaugccugcaaacggcgcucuauuaaguccuuuuucagcagacugaauuggcuccaccaacugaaguacaaauauccugcgcuuaacgucaccaugcccaauaacgauaaguuugacaaacuguacaucuggggcgugcaucacccuucuacagauuccgaccagaccagccucuacgcccaggcuuccgggcggguuacggugucuacaaagcgcagccagcaaaccgucauuccgaauaucggauccagacccugggugcggggcgugagcucucgcauuuccaucuauuggacaauugucaaaccuggggacauccugcugaucaacagcaccggaaaccucauugcccccagaggcuacuucaagauccggucuggaaagagcuccauuaugcgcucugaugcuccuaucgggaaauguaauagcgagugcauuacccccaacggcuccaucccgaaugacaagccuuuucagaacguuaauagaaucacauauggcgccuguccccgguacgugaaacagaacacgcugaaacuugcgaccgggaugcgcaaugugccugaaaagcagacaagaggaauuuucggcgccaucgcuggguuuauugagaacggaugggaaggcauggucgaugggugguauggauuccggcaccaaaauagcgagggcaccggccaggccgcugaccugaagucuacacaggccgccaucaaccaaauuaaugggaaacucaacagacugaucgagaagaccaaugaaaaguuucaucagaucgagaaagaguucuccgaaguggaaggacgcauucaggaucuugagaaguacguugaggacacgaaaaucgaucuguggagcuauaacgcugaacuccugguggcgcuggagaaucagcacacaauugaccucaccgauucugaaaugaacaagcuguucgagcggaccagaaaacaacuucgcgaaaacgccgaggacaugggcaaugggugcuuuaagaucuaccauaagugugauaacgcuugcauuggauccauccggaauggcacauacgaccacgacgucuauagagaugaggcccugaacaaucgcuuccagauuaaagggguggaacucaagagcggcuacaaagacuggauccuguggaucuccuuugccauuucuugcuuccuucuguguguugugcuccugggauuuaucaugugggcuugccagaagggcaacauucgguguaauaucugcauuuga

SEQ ID NO: 186034 - RNA, 1701 nt, Artificial Sequence
  derived and/or modified sequence opt5 from hemagglutinin__InfluenzaA__ACT21472
augaagaccaucauugcccugagcuacaucuccugccucguguucgcucagaaacugcccggcaacgacaauucuacagccacgcuuugucuggggcaccaugcggucccuaacggaacccucguuaagacaauuaccaaugaucaaaucgaggugacaaacgcuaccgaacuggugcagagcuccucuacaggcagaauuugcgacagcccgcaccggauccuugauggggagaauuguacccugaucgacgcccuccugggagauccccauugcgacggcuuucagaacaaagaaugggaucuguucgucgagcgcuccaaggccuauucuaauuguuacccuuaugacgugcccgauuacgcuagccucagaucccugguugccagcucugggacgcuugaauuuaacaaugaguccuucaacuggaccggaguggcucaggacggcacaagcuaugccugcaaacggcgcucuauuaaguccuuuuucagcacccugaauuggcuccaccaacugaaguacaaauauccugcgcuuaacgucacaaugcccaauaacgauaaguuugacaaacuguacaucuggggcgugcaucacccuucuaccgauuccgaccagacgagccucuacgcccaggcuuccgggagaguuacagugucuaccaagcggagccagcaaacagucauuccgaauaucggaucccgccccugggugagaggcgugagcucucggauuuccaucuauuggaccauugucaaaccuggggacauccugcugaucaacagcaccggaaaccucauugcccccagaggcuacuucaagaucagaucuggaaagagcuccauuaugcggucugaugcuccuaucgggaaauguaauagcgagugcauuacacccaacggcuccaucccgaaugacaagccuuuucagaacguuaaucgcaucacguauggcgccugucccagauacgugaaacagaacacccugaaacuugcgacagggaugcggaaugugccugaaaagcagacccgcggaauuuucggcgccaucgcuggguuuauugagaacggaugggaaggcauggucgaugggugguauggauucagacaccaaaauagcgagggcacaggccaggccgcugaccugaagucuacccaggccgccaucaaccaaauuaaugggaaacucaaccggcugaucgagaagacgaaugaaaaguuucaucagaucgagaaagaguucuccgaaguggaaggacgcauucaggaucuugagaaguacguugaggacacaaaaaucgaucuguggagcuauaacgcugaacuccugguggcgcuggagaaucagcacaccauugaccucaccgauucugaaaugaacaagcuguucgagcgcacacggaaacaacuuagagaaaacgccgaggacaugggcaaugggugcuuuaagaucuaccauaagugugauaacgcuugcauuggauccauccgcaauggcaccuacgaccacgacgucuaucgggaugaggcccugaacaauagauuccagauuaaagggguggaacucaagagcggcuacaaagacuggauccuguggaucuccuuugccauuucuugcuuccuucuguguguugugcuccugggauuuaucaugugggcuugccagaagggcaacauucgcuguaauaucugcauuuga

SEQ ID NO: 186035 - RNA, 1701 nt, Artificial Sequence
  derived and/or modified sequence opt5 from hemagglutinin__InfluenzaA__ACT21507
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauagaacccugauugacgcccuccugggcgauccccagugugacggguuucaaaacaaaaagugggaucuguucgucgaacggagcaaagccuauuccaauugcuacccuuaugacgugcccgauuacgcuucucuccgcagccugguugccuccagcggaacgcuugaguuuaacaaugaaucuuucaacuggaccggcgugacacagaauggcaccuccagcgcuuguaaggggagaucuaacaauuccuuuuucagccggcugaacuggcucacacaucugaaguuuaaauauccugcccuuaaugucaccaugcccaacaacgagaaguucgacaaacuguacaucuggggagugcaccauccuggcacggauaaugaccagauuucucucuaugcgcaggccuccgggcgcaucacaguuagcaccaagagaucccaacagacagugauuccgaacaucggaucucggccccgcgucagagauauuccuagccggaucuccaucuacuggaccauugugaaacccggcgacauccugcugauuaauagcaccgggaaccucaucgcuccucgcggauacuuuaagauuagaucuggcaaguccagcaucaugcggucugacgcccccaucggcaaaugcaauagcgaguguauuacaccgaacggguccaucccuaaugauaagcccuuccagaacgugaaucgcauuacguauggagcuugcccuagauacgucaaacagaacacccugaagcuggccacaggcaugcggaauguucccgaaaaacaaacccgcgggaucuuuggagcgauugccggcuucaucgagaacgggugggaaggaaugguggacggcugguauggcuuuagacaccaaaauucugaggggaucggacaggcugccgaucuuaagagcacacaggcugccauuaaccagaucaauggcaaacucaaccggcugauugggaagaccaacgagaaguuccaccagaucgaaaaagaguucuccgaaguggagggacgcauucaggaccuugaaaaguacgucgaggauacgagaaucgaccuguggagcuauaaugccgagcuccugguggcucuggaaucucaacauacaauugaucucaccgacuccgagaugaacaaacuguuugaacggaccaagaaacagcuuagagagaaugcggaagauaugggcaacggguguuucaagaucuaccacaagugcgacaaugccuguaucggcagcauucgcaacggaacauaugaucaugacguuuaccgggacgaggcucugaauaaaagauuucagaucaagggcguggagcucaaaucuggguacaaggauuggauucuguggaucuccuucgccauuagcugcuuucuucugugcgucgcccuccugggauucaucaugugggcuugucagaaaggcaacauccgcugcaauauuuguaucuga

SEQ ID NO: 186036 - RNA, 1701 nt, Artificial Sequence
  derived and/or modified sequence opt5 from hemagglutinin__InfluenzaA__ACT21508
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacaggacacccugaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacucaaucggcugauuggcaagaccaacgagaaguuccaccagaucgaaaaagaguucuccgaaguggaggggcgcauucaggaucuugaaaaguacgucgaggacacgaaaaucgaucuguggagcuauaacgccgagcuccugguggcucuggaaaaucaacauacaauugaccucaccgauucugagaugaacaagcuguuugaaagaaccaaaaagcagcuucgggagaaugcggaagacaugggaaacggcugcuucaagaucuaccacaaaugugauaaugccugcaucggguccauuagaaacggcacauaugaccaugacguuuaccgcgaugaggcucugaauaaccgguuucagaucaagggaguggagcucaaaagcggcuacaaggacuggauucuguggaucucuuucgccauuuccugcuuucuucugugugucgcccuccugggguucaucaugugggcuugccagaaaggaaauaucagauguaacauuugcaucuga

SEQ ID NO: 186037 - RNA, 1701 nt, Artificial Sequence
  derived and/or modified sequence opt5 from hemagglutinin__InfluenzaA__ACT21509
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuauuccaauuguuacccuuaugacgugcccgauuacgcuucucuccggagccugguugccuccagcggaacgcuugaguuuaacaaugaaucuuucaacuggaccggcgugacacagaauggcaccuccagcgcuugcaagcgcagaucuaacaauuccuuuuucagccggcugaacuggcucacacaucugaaguuuaaauauccugcccuuaaugucaccaugcccaacaacgagaaguucgacaaacuguacaucuggggagugcaccauccugggacggauaaugaccagauuucucucuaugcgcaggccuccggccgcaucacaguuagcaccaagagaucccaacagacagugauuccgaacaucgggucucggccccgcgucagagauauuccuagccggaucuccaucuacuggaccauugugaaacccggagacauccugcugauuaauagcaccggcaaccucaucgcuccucgcggguacuuuaagauuagaucuggaaaguccagcaucaugcggucugacgcccccaucggcaaauguaauagcgagugcauuacaccgaacggcuccaucccuaaugauaagcccuuccagaacgugaaucgcauuacguauggggcuuguccuagauacgucaaacagaacacccugaagcuggccacaggaaugcggaauguucccgaaacccaaacacgcggcaucuuuggggcgauugccggauucaucgagaacggcugggaagggaugguggacggaugguauggcuuuagacaccaaaauucugagggcaccgggcaggcugccgaucuuaaaagcacgcaggcugccaucaaccagauuaauggaaagcccaaccggcucaucggcaaaacaaacgagaaguuccaccagauugaaaaggaguucuccgaaguggaggggagaauccaggaccuggaaaaauacgucgaggauaccaagauugaccuuuggagcuauaaugccgagcugcucguggcucuggaaaaccaacauaccaucgaucugacagacucugagaugaauaaacucuuugaaaagaccaaaaagcagcugcgcgagaacgcggaagauaugggaaauggcugcuucaagauuuaccacaaaugugacaacgccugcaucggguccauccggaaugagacauaugaucaugacguuuacagagacgaggcucuuaacaaucgcuuucagauuaagggcguggaacugaaaagcggauacaaggauuggauccucuggauuucuuucgccaucuccugcuuucugcuuugugucgcccugcucggcuucauuaugugggcuugccagaaagggaacauccgguguaauaucugcauuuga

SEQ ID NO: 186038 - RNA, 1701 nt, Artificial Sequence
  derived and/or modified sequence opt5 from hemagglutinin__InfluenzaA__ACT21510
augaagaccaucauugcccugagcuacauccucugccccguguucgcucagaaacugccuggcaacgacaauuccacagccacgcuuugucuggggcaccaugcggucccgaacggaaccauuguuaagacaaucaccaaugaucaaauugaggugacaaacgcuaccgaacucgugcagucuagcuccacaggcgggaucugcgacucuccccaccagauccuggauggagagaauuguacccuuauugacgcccugcucggcgauccucagugcgacggguuucaaaacaaaaagugggaucuguucgucgaaagaagcaaagccuauuccaauuguuaccccuaugacgugccugauuacgcuucucugcggagccucguugccuccagcggaacgcuggaguuuaacaaugaaucuuucaacuggaccggcgugacacagaauggcaccuccagcgcuugcaagcgcagaucuaacaauuccuuuuucagccggcuuaacuggcugacacaucucaaguuuaaauaucccgcccugaaugucaccaugccuaacaacgagaaguucgacaaacuuuacaucuggggagugcaccauccggggacggauaaugaccagauuucucuguaugcgcaggccuccggccgcaucacaguuagcaccaagagaucccaacagacagugauucccaacaucgggucucggccucgcgucagagauauucccagccggaucuccaucuacuggaccauugugaaaccuggagacauccuccugauuaauagcaccggcaaccugaucgcuccccgcggguacuuuaagauuagaucuggaaaguccagcaucaugcggucugacgccccgaucggcaaauguaauagcgagugcauuacaccuaacggcuccauccccaaugauaagccuuuccaggacgugaaccgcauuacguauggggcuugucccagauacgucaaacagaauacccucaagcuggccacaggaaugcggaacguucccgaaaaacaaacccgcggcaucuuuggggcgauugccggauucaucgagaauggcugggaagggaugguggauggaugguauggcuuuagacaccagaacucugagggcaucgggcaggcugccgaccuuaagagcacacaagcugccauuaaucagaucaacggaaaacugaaucggcucauuggcaagaccaacgagaaguuccaccagaucgaaaaagaguucuccgaaguggaggggcgcauucaggaucuggaaaaguacgucgaggacacgaaaaucgaucuuuggagcuauaacgccgagcugcucguggcucuggaaaaucaacauacaauugaccugaccgauucugagaugaacaagcucuuugaaagaaccgagaaacagcugcgggaaaaugcggaggacaugggaaacggcugcuucaagaucuaccacaagugugauaaugccgggaucggcuccauuagaaacggaacauaugaccaugacguuuaccgcgaugaggcucuuaauaaccgguuucagaucaaaggcguggaacucaagagcggguacaaagacuggauucuguggaucucuuucgccauuuccugcuuucugcuuugcgucgcccugcucggauucaucaugugggcuugucagaagggcaauaucagaugcaacauuuguaucuga

SEQ ID NO: 186039 - RNA, 1701 nt, Artificial Sequence; identical to SEQ ID NO: 185937
  derived and/or modified sequence opt5 from hemagglutinin__InfluenzaA__ACT21572

SEQ ID NO: 186040 - RNA, 1701 nt, Artificial Sequence; identical to SEQ ID NO: 185693
  derived and/or modified sequence opt5 from hemagglutinin__InfluenzaA__ACT22031

SEQ ID NO: 186041 - RNA, 1701 nt, Artificial Sequence; identical to SEQ ID NO: 185693
  derived and/or modified sequence opt5 from hemagglutinin__InfluenzaA__ACT22032

SEQ ID NO: 186042 - RNA, 1701 nt, Artificial Sequence; identical to SEQ ID NO: 185693
  derived and/or modified sequence opt5 from hemagglutinin__InfluenzaA__ACT22033

SEQ ID NO: 186043 - RNA, 1701 nt, Artificial Sequence; identical to SEQ ID NO: 185693
  derived and/or modified sequence opt5 from hemagglutinin__InfluenzaA__ACT22034

SEQ ID NO: 186044 - RNA, 1701 nt, Artificial Sequence; identical to SEQ ID NO: 185708
  derived and/or modified sequence opt5 from hemagglutinin__InfluenzaA__ACT22035

SEQ ID NO: 186045 - RNA, 1701 nt, Artificial Sequence
  derived and/or modified sequence opt5 from hemagglutinin__InfluenzaA__ACT22036
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucauuaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggauccagcagauauucuaagaaauuuaagccugagaucgcuauucggccgaaagugcgcgaucaggaggggagaaugaauuacuauuggacacuggucgaacccggagacaagaucaccuucgaggccacgggcaaccugguugugccucgguacgcguuugccauggaacgcaacgcuggguccggaauuaucaucagcgauacacccgugcaugacugcaauaccacaugucaaaccccuaaaggcgccauuaacaccucucuccccuuccagaauauccacccgauuacaaucggcaagugcccuaaguaugucaaaagcacgaagcugagacuugcuaccgggcugcggaacgugcccuccauucagucucgcggacucuuuggcgccaucgccggguucaucgagggaggcuggacagggaugguugacggaugguacggcuaucaucaccagaaugaacaaggcagcggguacgcugcggaucugaaauccacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 186046 - RNA, 1701 nt, Artificial Sequence
  derived and/or modified sequence opt5 from hemagglutinin__InfluenzaA__ACT22037
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacagcaaugugaaaaaccuguacgaaaagguccgcucucagcucaaaaacaaugccaaggagauugggaacggauguuuugaguucuaucacaagugcgauaauacauguauggaguccgugaaaaacggcaccuacgacuauccuaaguacagcgaagaggcuaaacugaauagagaggaaaucgaugggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186047 - RNA, 1701 nt, Artificial Sequence
  derived and/or modified sequence opt5 from hemagglutinin__InfluenzaA__ACT22038
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccaacgccgaucaacagucucucuaccagaaugcugacgccuacguguucgugggcagcuccagauauagcaagaaauuuaagccugagauugcuauccggccgaaaguccgcgaucaggaggggagaaugaacuacuauuggacacugguugaacccggagacaagauuaccuucgaggccacgggcaaccugguggugccucgguacgcguuugccauggaacgcaaugcugggucuggaaucauuaucuccgauacacccguccaugacugcaacaccacaugucaaaccccuaaaggcgccaucaauaccagccuccccuuccagaacauucacccgaucacaauuggcaagugcccuaaguaugugaaaucuacgaagcugagacuugcuaccgggcugcggaauguucccagcauccagucccgcggacucuuuggcgccauugccggguucaucgagggaggcuggacagggaugguggacggaugguacggcuaucaucaccagaacgaacaaggcucuggguacgcugcggaucugaaaagcacccagaaugccaucgacgagauuacaaacaaggucaauuccgugaucgagaaaaugaacacccaguuuacggcuguuggaaaggaguucaaucaccuugagaagagaauugaaaaccugaauaaaaagguggaugacggcuuccucgauaucuggacauacaacgccgagcugcugguccuccuggaaaaugagcggacccuugacuaucaugauagcaacgugaaaaaccuguacgagaagguccgcucucagcucaaaaauaacgccaaggaaauugggaauggauguuuugaguucuaucacaagugcgacaacaccuguauggaauccgugaaaaauggcacauacgauuauccuaaguacagcgaggaagcuaaacugaacagagaggagaucgacgggguuaaacuugaaucuacccggaucuaucaaauucuggccaucuacuccacaguggcgagcucccucguccuggugguuucucugggcgcuauuagcuuuuggaugugcuccaauggaucucuccagugccgcaucuguauuuga

SEQ ID NO: 186048 - RNA, 1701 nt, Artificial Sequence
  derived and/or modified sequence opt5 from hemagglutinin__InfluenzaA__ACT22055
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacugagaaaguccuauauuaaugacaaggggaaagaagugcuuguccuguggggaauccaccaccccagcaccuccgccgaucaacagucucucuaccagaacgcugacgccuacguguucgugggcacaagccgguauuccaagaaauuuaagccugagauugcuauccgcccgaaagucagagaucaggaggggcggaugaauuacuauuggacccugguugaacccggagacaagauuacguucgaggccacaggcaaccugguggugccucgcuacgcguuugccauggaaagaaacgcugggagcggaaucauuaucucugauacccccguccaugacugcaauacaaccugucaaaccccuaaaggcgccaucaacacaucccuccccuuccagaauauucacccgaucacgauuggcaagugcccuaaguaugugaaaagcaccaagcugcggcuugcuacagggcugcgcaacguucccucuauccagagcagaggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagcggauugaaaaucugaacaaaaagguggaugacggcuuccucgauaucuggaccuacaaugccgagcugcugguccuccuggaaaacgagcgcacccuugacuaucaugauuccaaugugaaaaaccuguacgagaaggucagaagccagcucaaaaacaaugccaaggaaauugggaacggauguuuugaguucuaucacaagugcgacaauacauguauggaaucugugaaaaacggcaccuacgauuauccuaaguacuccgaggaagcuaaacugaaucgggaggagaucgacgggguuaaacuugaaagcacacgcaucuaucaaauucuggccaucuacucuacgguggcguccagccucguccuggugguuucccugggcgcuauuucuuuuuggaugugcagcaacggaucccuccagugcagaaucuguauuuga

SEQ ID NO: 186049 - RNA, 1701 nt, Artificial Sequence; identical to SEQ ID NO: 186006
  derived and/or modified sequence opt5 from hemagglutinin__InfluenzaA__ACT22504

SEQ ID NO: 186050 - RNA, 1701 nt, Artificial Sequence; identical to SEQ ID NO: 185935
  derived and/or modified sequence opt5 from hemagglutinin__InfluenzaA__ACT33122

SEQ ID NO: 186051 - RNA, 1701 nt, Artificial Sequence
  derived and/or modified sequence opt5 from hemagglutinin__InfluenzaA__ACT33123
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccaguuccgcaucugcauuuga

SEQ ID NO: 186052 - RNA, 1701 nt, Artificial Sequence; identical to SEQ ID NO: 185693
  derived and/or modified sequence opt5 from hemagglutinin__InfluenzaA__ACT33125

SEQ ID NO: 186053 - RNA, 1701 nt, Artificial Sequence
  derived and/or modified sequence opt5 from hemagglutinin__InfluenzaA__ACT36505
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugauugaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 186054 - RNA, 1701 nt, Artificial Sequence
  derived and/or modified sequence opt5 from hemagglutinin__InfluenzaA__ACT36649
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagcccgguccuggucuuacaucguggagaccagcuccucugacaacggcacgugcuauccgggggauuuuauugacuacgaagaacugcgcgagcagcuuaauagcgucuccagcuucgaaagauuugagaucuuccccaagaccucuuccuggccuaaccacgauagcaauaagggagugacagccgcuuguccccaugccggcgcgaaaucuuuuuauaagaaccugaucuggcucguuaaaaagggcaauuccuacccuaaacugagcaagucuuauauuaacgacaaggggaaagaagugcuuguccuguggggaauccaccaccccuccaccagcgccgaucaacagucccucuaccagaaugcugacgccuacguguucgugggcucuagccgguauuccaagaaauuuaagccugagauugcuauccgcccgaaagucagagaucaggaggggcggaugaacuacuauuggacacugguugaacccggagacaagauuaccuucgaggccacgggcaaccugguggugccucgcuacgcguuugccauggaaagaaaugcugggagcggaaucauuaucucugauacacccguccaugacugcaacaccacaugucaaaccccuaaaggcgccaucaauaccucccuccccuuccagaacauucacccgaucacaauuggcaagugcccuaaguaugugaaaagcacgaagcugcggcuugcuaccgggcugcgcaauguucccucuauccagagcagaggacucuuuggcgccauugccggguucaucgagggaggcuggacagggaugguggacggaugguacggcuaucaucaccagaacgaacaaggcuccggguacgcugcggaucugaaaucuacccagaaugccaucgacgagauuacaaacaaggucaauagcgugaucgagaaaaugaacacccaguuuacggcuguuggaaaggaguucaaucaccuugagaagcggauugaaaaccugaauaaaaagguggaugacggcuuccucgauaucuggacauacaacgccgagcugcugguccuccuggaaaaugagcgcacccuugacuaucaugauuccaacgugaaaagccuguacgagaaggucagaucucagcucaaaaacaaugccaaggaaauugggaacggauguuuugaguucuaucacaagugcgacaauaccuguauggaauccgugaaaaacggcacauacgauuauccuaaguacagcgaggaagcuaaacugaaucgggaggagaucgacgggguuaaacuugaaucuacccgcaucuaucaaauucuggccaucuacuccacaguggcgagcucccucguccuggugguuucucugggcgcuauuagcuuuuggaugugcuccaacggaucucuccagugcagaaucuguauuuga

SEQ ID NO: 186055 - RNA, 1701 nt, Artificial Sequence; identical to SEQ ID NO: 185693
  derived and/or modified sequence opt5 from hemagglutinin__InfluenzaA__ACT36650

SEQ ID NO: 186056 - RNA, 1701 nt, Artificial Sequence; identical to SEQ ID NO: 185693
  derived and/or modified sequence opt5 from hemagglutinin__InfluenzaA__ACT36652

SEQ ID NO: 186057 - RNA, 1701 nt, Artificial Sequence; identical to SEQ ID NO: 185691
  derived and/or modified sequence opt5 from hemagglutinin__InfluenzaA__ACT36653

SEQ ID NO: 186058 - RNA, 1701 nt, Artificial Sequence
  derived and/or modified sequence opt5 from hemagglutinin__InfluenzaA__ACT36655
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucgugggguccagcagauauucuaagaaauuuaagccugagauugcuauccggccgaaaguccgcgaccaggagggaagaaugaauuacuauuggacacugguugaacccggcgauaagauuaccuucgaggccacggggaaccugguggugccucgguacgcguuugccauggaacgcaacgcuggauccggcaucauuaucagcgacacacccguccaugauugcaauaccacaugucaaaccccuaaaggcgccaucaacaccucucuccccuuccagaauauucacccgaucacaauugggaagugcccuaaguaugugaaaagcacgaagcugagacuugcuaccggacugcggaacguucccuccauccagucucgcggccucuuuggggccauugccggauucaucgagggcggguggacaggaaugguggacggcugguacggcuaucaucaccagaaugaacaagggagcggauacgcugcggaccugaaauccacccagaacgccaucgaugagauuacaaauaaggucaacagcgugaucgagaaaaugaauacccaguuuacggcuguuggcaaggaguucaaccaccuugagaagagaauugaaaaucugaacaaaaagguggacgauggguuccucgacaucuggacauacaaugccgagcugcugguccuccuggaaaacgagcggacccuugauuaucaugacucuaaugugaaaaaccuguacgagaagguccgcucccagcucaaaaacaaugccaaggaaauuggaaacggcuguuuugaguucuaucacaagugcgauaauaccuguauggaaagcgugaaaaacgggacauacgacuauccuaaguacucugaggaagcuaaacugaauagagaggagaucgauggcguuaaacuugaauccacccggaucuaucaaauucuggccaucuacagcacaguggcguccucucucguccuggugguuagccugggagcuauuuccuuuuggaugugcucuaacggcagccuccagugccgcaucuguauuuga

SEQ ID NO: 186059 - RNA, 1701 nt, Artificial Sequence; identical to SEQ ID NO: 185680
  derived and/or modified sequence opt5 from hemagglutinin__InfluenzaA__ACT36658

SEQ ID NO: 186060 - RNA, 1701 nt, Artificial Sequence; identical to SEQ ID NO: 185719
  derived and/or modified sequence opt5 from hemagglutinin__InfluenzaA__ACT36659

SEQ ID NO: 186061 - RNA, 1701 nt, Artificial Sequence; identical to SEQ ID NO: 185680
  derived and/or modified sequence opt5 from hemagglutinin__InfluenzaA__ACT36661

SEQ ID NO: 186062 - RNA, 1701 nt, Artificial Sequence; identical to SEQ ID NO: 185693
  derived and/or modified sequence opt5 from hemagglutinin__InfluenzaA__ACT36663

SEQ ID NO: 186063 - RNA, 1701 nt, Artificial Sequence; identical to SEQ ID NO: 185693
  derived and/or modified sequence opt5 from hemagglutinin__InfluenzaA__ACT36666

SEQ ID NO: 186064 - RNA, 1701 nt, Artificial Sequence
  derived and/or modified sequence opt5 from hemagglutinin__InfluenzaA__ACT52687
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgggcaggagggaagaaugaauuacuauuggacacugguugaacccggcgauaagauuaccuucgaggccacggggaaccugguggugccucgguacgcguuugccauggaacgcaacgcuggauccggcaucauuaucagcgacacacccguccaugauugcaauaccacaugucaaaccccuaaaggcgccaucaacaccucucuccccuuccagaauauucacccgaucacaauugggaagugcccuaaguaugugaaaagcacgaagcugagacuugcuaccggacugcggaacguucccuccauccagucucgcggccucuuuggggccauugccggauucaucgagggcggguggacaggaaugguggacggcugguacggcuaucaucaccagaaugaacaagggagcggauacgcugcggaccugaaauccacccagaacgccaucgaugagauuacaaauaaggucaacagcgugaucgagaaaaugaauacccaguuuacggcuguuggcaaggaguucaaccaccuugagaagagaauugaaaaucugaacaaaaagguggacgauggguuccucgacaucuggacauacaaugccgagcugcugguccuccuggaaaacgagcggacccuugauuaucaugacucuaaugugaaaaaccuguacgagaagguccgcucccagcucaaaaacaaugccaaggaaauuggaaacggcuguuuugaguucuaucacaagugcgauaauaccuguauggaaagcgugaaaaacgggacauacgacuauccuaaguacucugaggaagcuaaacugaauagagaggagaucgauggcguuaaacuugaauccacccgguuuuaucaaauccuggccauuuacagcacaguggcguccucucucguccuggugguuagccugggagcuaucuccuucuggaugugcucuaacggcagccuccagugccgcauuuguaucuga

SEQ ID NO: 186065 - RNA, 1701 nt, Artificial Sequence; identical to SEQ ID NO: 185680
  derived and/or modified sequence opt5 from hemagglutinin__InfluenzaA__ACT54606

SEQ ID NO: 186066 - RNA, 1701 nt, Artificial Sequence; identical to SEQ ID NO: 185693
  derived and/or modified sequence opt5 from hemagglutinin__InfluenzaA__ACT66146

SEQ ID NO: 186067 - RNA, 1701 nt, Artificial Sequence; identical to SEQ ID NO: 185935
  derived and/or modified sequence opt5 from hemagglutinin__InfluenzaA__ACT66155

SEQ ID NO: 186068 - RNA, 1701 nt, Artificial Sequence
  derived and/or modified sequence opt5 from hemagglutinin__InfluenzaA__ACT66162
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacaccuuuccagcgucucuuccuucgagcgcuuugaaaucuuccccaaaaccagcucuuggccuaaucaugauuccaacaagggagugacagccgcuuguccccacgccggcgccaagagcuuuuauaaaaaucugaucuggcucguuaagaaaggcaacucuuacccuaagcuguccaaaagcuauauuaaugacaaggggaaggaggugcuuguccuguggggaauccaccaucccuccaccucugccgaucagcaaagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccacgacugcaauaccacaugucagaccccuaagggcgccaucaacaccucucuccccuuccaaaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuauccuaaauacucugaagaggcuaagcugaauagagaggaaaucgacgggguuaaacuugaguccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 186069 - RNA, 1701 nt, Artificial Sequence; identical to SEQ ID NO: 185693
  derived and/or modified sequence opt5 from hemagglutinin__InfluenzaA__ACT67239

SEQ ID NO: 186070 - RNA, 1701 nt, Artificial Sequence; identical to SEQ ID NO: 185693
  derived and/or modified sequence opt5 from hemagglutinin__InfluenzaA__ACT67255

SEQ ID NO: 186071 - RNA, 1701 nt, Artificial Sequence; identical to SEQ ID NO: 185680
  derived and/or modified sequence opt5 from hemagglutinin__InfluenzaA__ACT68102

SEQ ID NO: 186072 - RNA, 1701 nt, Artificial Sequence
  derived and/or modified sequence opt5 from hemagglutinin__InfluenzaA__ACT68103
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaacccucaaaggcgccaucaacaccucucugccuuuccagaauauucaccccaucacaauuggcaagugcccgaaguaugugaaaagcacgaaacuuagacuggcuaccgggcuccggaacguuccuuccauccagucucgcggacuguuuggcgccauugccggguucaucgagggaggcuggacagggaugguggacggaugguacggcuaucaucaccagaaugaacaaggcagcggguacgcugcggaucuuaaguccacccagaacgccaucgacgagauuacaaauaaggucaacagcgugaucgagaaaaugaauacccaguuuacggcuguuggaaaggaguucaaccaccuggagaagagaauugaaaaucucaacaaaaagguggaugacggcuuccuggauaucuggacauacaaugccgagcugcucguccugcuugaaaacgagcggacccuggacuaucaugauucuaaugugaaaaaccucuacgagaagguccgcucccagcugaaaaacaaugccaaggaaauugggaacggauguuuugaguucuaucacaagugcgacaauaccuguauggaaagcgugaaaaacggcacauacgauuaucccaaguacucugaggaagcuaaacuuaauagagaggagaucgacgggguuaagcuggaauccacccggaucuaucaaauucucgccaucuacagcacaguggcguccucucugguccuggugguuagccucggcgcuauuuccuuuuggaugugcucuaacggaagccugcagugccgcaucuguauuuga

SEQ ID NO: 186073 - RNA, 1701 nt, Artificial Sequence; identical to SEQ ID NO: 185680
  derived and/or modified sequence opt5 from hemagglutinin__InfluenzaA__ACT68104

SEQ ID NO: 186074 - RNA, 1701 nt, Artificial Sequence
  derived and/or modified sequence opt5 from hemagglutinin__InfluenzaA__ACT68105
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaacgcauugaaaaucugaacaagaaaguggaugacggcuuccucgauaucuggacauacaaugccgagcugcugguccuccuggaaaacgagagaacccuugacuaucaugauucuaaugugaagaaccuguacgagaaaguccggucccagcucaagaacaaugccaaggaaauugggaacggauguuuugaguucuaucacaaaugcgacaauaccuguauggaaagcgugaagaacggcacauacgauuauccuaaauacucuggggaggcuaagcugaaucgcgaagagaucgacggcguuaaacuugaguccaccagaaucuaucaaauucuggccaucuacagcacaguggcguccucucucguccuggugguuagccugggagcuauuuccuuuuggaugugcucuaacggcagccuccagugccggaucuguauuuga

SEQ ID NO: 186075 - RNA, 1701 nt, Artificial Sequence; identical to SEQ ID NO: 185680
  derived and/or modified sequence opt5 from hemagglutinin__InfluenzaA__ACT68106

SEQ ID NO: 186076 - RNA, 1701 nt, Artificial Sequence; identical to SEQ ID NO: 185680
  derived and/or modified sequence opt5 from hemagglutinin__InfluenzaA__ACT68107

SEQ ID NO: 186077 - RNA, 1701 nt, Artificial Sequence; identical to SEQ ID NO: 185873
  derived and/or modified sequence opt5 from hemagglutinin__InfluenzaA__ACT68108

SEQ ID NO: 186078 - RNA, 1701 nt, Artificial Sequence
  derived and/or modified sequence opt5 from hemagglutinin__InfluenzaA__ACT68109
augaaggccauccuggugguccuccuguacaccuucgcuacagccaacacggacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 186079 - RNA, 1701 nt, Artificial Sequence; identical to SEQ ID NO: 185680
  derived and/or modified sequence opt5 from hemagglutinin__InfluenzaA__ACT68110

SEQ ID NO: 186080 - RNA, 1701 nt, Artificial Sequence; identical to SEQ ID NO: 185680
  derived and/or modified sequence opt5 from hemagglutinin__InfluenzaA__ACT68112

SEQ ID NO: 186081 - RNA, 1701 nt, Artificial Sequence; identical to SEQ ID NO: 185680
  derived and/or modified sequence opt5 from hemagglutinin__InfluenzaA__ACT68113

SEQ ID NO: 186082 - RNA, 1701 nt, Artificial Sequence; identical to SEQ ID NO: 185680
  derived and/or modified sequence opt5 from hemagglutinin__InfluenzaA__ACT68115

SEQ ID NO: 186083 - RNA, 1701 nt, Artificial Sequence; identical to SEQ ID NO: 185680
  derived and/or modified sequence opt5 from hemagglutinin__InfluenzaA__ACT68119

SEQ ID NO: 186084 - RNA, 1701 nt, Artificial Sequence
  derived and/or modified sequence opt5 from hemagglutinin__InfluenzaA__ACT79133
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggaagcugguugaacccggagacaaaauuaccuucgaggccacgggcaaccugguggugccucgguacgcguuugccauggaacgcaacgcugggucuggaaucauuaucuccgauacacccguccaugacugcaauaccacaugucaaaccccuaagggcgccaucaacaccagccuccccuuccagaauauucacccgaucacaauuggcaagugcccuaaauaugugaagucuacgaaacugagacuugcuaccgggcugcggaacguucccagcauccagucccgcggacucuuuggcgccauugccggguucaucgagggaggcuggacagggaugguggacggaugguacggcuaucaucaccagaaugaacaaggcucuggguacgcugcggaucuuaagagcacccagaacgccaucgacgagauuacaaauaaagucaacuccgugaucgagaagaugaauacccaguuuacggcuguuggaaaggaguucaaccaccuggagaaaagaauugaaaaucugaacaagaaaguggaugacggcuuccucgauaucuggacauacaaugccgagcugcugguccuccuggaaaacgagcggacccuugacuaucaugauagcaaugugaagaaccuguacgagaaaguccgcucucagcucaagaacaaugccaaggaaauugggaacggauguuuugaguucuaucacaaaugcgacaauaccuguauggaauccgugaagaacggcacauacgauuauccuaaauacagcgaggaagcuaagcugaauagagaggagaucgacgggguuaaacuugaaucuacccggaucuaucaaauucuggccaucuacuccacaguggcgagcucccucguccuggugguuucucugggcgcuauuagcuuuuggaugugcuccaacggaucucuccagugccgcaucuguauuuga

SEQ ID NO: 186085 - RNA, 1701 nt, Artificial Sequence; identical to SEQ ID NO: 185680
  derived and/or modified sequence opt5 from hemagglutinin__InfluenzaA__ACT79143

SEQ ID NO: 186086 - RNA, 1701 nt, Artificial Sequence; identical to SEQ ID NO: 185719
  derived and/or modified sequence opt5 from hemagglutinin__InfluenzaA__ACT79153

SEQ ID NO: 186087 - RNA, 1701 nt, Artificial Sequence; identical to SEQ ID NO: 186006
  derived and/or modified sequence opt5 from hemagglutinin__InfluenzaA__ACT79163

SEQ ID NO: 186088 - RNA, 1701 nt, Artificial Sequence; identical to SEQ ID NO: 186006
  derived and/or modified sequence opt5 from hemagglutinin__InfluenzaA__ACT79173

SEQ ID NO: 186089 - RNA, 1701 nt, Artificial Sequence
  derived and/or modified sequence opt5 from hemagglutinin__InfluenzaA__ACT79625
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagaucgaugacggcuuccucgauauuuggaccuacaaugcugagcugcuggugcuccugaaaaacgaacggacacuugacuaucaugauagcaaugucaagaaccuguacgagaaagugcgcucucagcucaagaacaaugccaaggagaucgggaacggauguuuugaguucuaucacaaaugcgacaauaccuguauggaauccgucaagaacggcacauacgauuauccuaaauacagcgaagaggccaagcugaauagagaagagaucgacggggugaaacuugagucuacgcggauuuaucaaauccuggcuauuuacuccaccguugccagcucccucgugcuggucgugucucugggcgcgaucagcuuuuggaugugcuccaacggaucucuccagugccgcauuuguaucuga

SEQ ID NO: 186090 - RNA, 1701 nt, Artificial Sequence; identical to SEQ ID NO: 185680
  derived and/or modified sequence opt5 from hemagglutinin__InfluenzaA__ACT79627

SEQ ID NO: 186091 - RNA, 1701 nt, Artificial Sequence
  derived and/or modified sequence opt5 from hemagglutinin__InfluenzaA__ACT82512
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucaguuuaaaaacaaugccaaggaaauugggaacggauguuucgaguuuuaucacaagugcgacaauacauguauggaauccgugaaaaacggcaccuacgauuauccuaaguacagcgaggaagcuaaacucaauagagaggagaucgacgggguuaagcuggaaucuacacggaucuaucaaauucuugccaucuacuccacgguggcgagcucccugguccucgugguuucucugggcgcuauuagcuucuggaugugcuccaacggaucucugcagugccgcaucuguauuuga

SEQ ID NO: 186092 - RNA, 1701 nt, Artificial Sequence; identical to SEQ ID NO: 185693
  derived and/or modified sequence opt5 from hemagglutinin__InfluenzaA__ACT82513

SEQ ID NO: 186093 - RNA, 1701 nt, Artificial Sequence
  derived and/or modified sequence opt5 from hemagglutinin__InfluenzaA__ACT82514
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccaauacccccguccaugauugcaacacaaccugucaaaccccuaaaggcagcaucaauacaucucuccccuuccagaacauucacccgaucacgauuggcaagugcccuaaguaugugaaaagcaccaagcugagacuugccacagggcugcggaauguucccuccauccagucucgcggacucuuuggcgcuauugccggguucaucgagggaggcuggaccgggaugguggacggaugguacggcuaucaucaccagaacgaacaaggcagcggguacgccgcugaccugaaauccacacagaaugcgaucgaugagauuaccaacaaggucaauagcgugaucgagaaaaugaacacgcaguuuacagccguuggaaaggaguucaaucaccuugagaagagaauugaaaaccugaauaaaaagguggacgauggcuuccucgacaucuggaccuacaacgcugagcugcugguccuccuggaaaaugagcggacccuugauuaucaugacucuaacgugaaaaaccuguacgagaagguccgcucccagcucaaaaauaacgccaaggaaauugggaauggauguuuugaguucuaucacaagugcgauaacacauguauggaaagcgugaaaaauggcaccuacgacuauccuaaguacucugaggaagccaaacugaacagagaggagaucgaugggguuaaacuugaauccacacggaucuaucaaauucuggcuaucuacagcacgguggccuccucucucguccuggugguuagccugggcgcgauuuccuuuuggaugugcucuaauggaagccuccagugccgcaucuguauuuga

SEQ ID NO: 186094 - RNA, 1701 nt, Artificial Sequence; identical to SEQ ID NO: 185693
  derived and/or modified sequence opt5 from hemagglutinin__InfluenzaA__ACT82515

SEQ ID NO: 186095 - RNA, 1701 nt, Artificial Sequence
  derived and/or modified sequence opt5 from hemagglutinin__InfluenzaA__ACT82516
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugauggugccucgguacgcguuugccauggaacgcaacgcuggguccggaaucauuaucagcgauacacccgugcaugacugcaauaccacaugucaaaccccuaaaggcgccaucaacaccucucuccccuuccacaauauucauccgaucacaauuggcaagugcccuaaguaugucaaaagcacgaagcugagacuugcuaccgggcugcggaacgugcccuccauccagucucgcggacucuuuggcgccauugccggguucaucgagggaggcuggacagggaugguugacggaugguacggcuaucaccaccagaaugaacagggcagcggguacgcugcggaucugaaauccacccaaaacgccaucgacgagauuacaaauaaggugaacagcgucaucgagaaaaugaauacccaguuuacggcugugggaaaggaguucaaccaucuugagaagagaauugaaaaucugaacaaaaagguugaugacggcuuccucgauaucuggacauacaaugccgagcugcuggugcuccuggaaaacgagcggacccuugacuaucacgauucuaaugucaaaaaccuguacgagaaggugcgcucccagcucaaaaacaaugccaaggaaauugggaacggauguuuugaguucuaucauaagugcgacaauaccuguauggaaagcgucaaaaacggcacauacgauuauccuaaguacucugaggaagcuaaacugaauagagaggagaucgacggggugaaacuugaauccacccggaucuaucagauucuggccaucuacagcacaguugcguccucucucgugcuggucgugagccugggcgcuauuuccuuuuggaugugcucuaacggaagccuccaaugccgcaucuguauuuga

SEQ ID NO: 186096 - RNA, 1701 nt, Artificial Sequence; identical to SEQ ID NO: 185935
  derived and/or modified sequence opt5 from hemagglutinin__InfluenzaA__ACT83795

SEQ ID NO: 186097 - RNA, 1701 nt, Artificial Sequence; identical to SEQ ID NO: 185935
  derived and/or modified sequence opt5 from hemagglutinin__InfluenzaA__ACT83805

SEQ ID NO: 186098 - RNA, 1701 nt, Artificial Sequence; identical to SEQ ID NO: 185693
  derived and/or modified sequence opt5 from hemagglutinin__InfluenzaA__ACT83815

SEQ ID NO: 186099 - RNA, 1701 nt, Artificial Sequence; identical to SEQ ID NO: 185693
  derived and/or modified sequence opt5 from hemagglutinin__InfluenzaA__ACT83825

SEQ ID NO: 186100 - RNA, 1701 nt, Artificial Sequence; identical to SEQ ID NO: 185693
  derived and/or modified sequence opt5 from hemagglutinin__InfluenzaA__ACT83835

SEQ ID NO: 186101 - RNA, 1701 nt, Artificial Sequence; identical to SEQ ID NO: 185786
  derived and/or modified sequence opt5 from hemagglutinin__InfluenzaA__ACT83845

SEQ ID NO: 186102 - RNA, 1701 nt, Artificial Sequence; identical to SEQ ID NO: 185680
  derived and/or modified sequence opt5 from hemagglutinin__InfluenzaA__ACT83855

SEQ ID NO: 186103 - RNA, 1701 nt, Artificial Sequence; identical to SEQ ID NO: 185693
  derived and/or modified sequence opt5 from hemagglutinin__InfluenzaA__ACT83865

SEQ ID NO: 186104 - RNA, 1701 nt, Artificial Sequence; identical to SEQ ID NO: 185935
  derived and/or modified sequence opt5 from hemagglutinin__InfluenzaA__ACT83875

SEQ ID NO: 186105 - RNA, 1701 nt, Artificial Sequence; identical to SEQ ID NO: 185935
  derived and/or modified sequence opt5 from hemagglutinin__InfluenzaA__ACT85999

SEQ ID NO: 186106 - RNA, 1701 nt, Artificial Sequence; identical to SEQ ID NO: 185935
  derived and/or modified sequence opt5 from hemagglutinin__InfluenzaA__ACT86009

SEQ ID NO: 186107 - RNA, 1701 nt, Artificial Sequence; identical to SEQ ID NO: 185693
  derived and/or modified sequence opt5 from hemagglutinin__InfluenzaA__ACT86019

SEQ ID NO: 186108 - RNA, 1701 nt, Artificial Sequence; identical to SEQ ID NO: 185786
  derived and/or modified sequence opt5 from hemagglutinin__InfluenzaA__ACT86029

SEQ ID NO: 186109 - RNA, 1701 nt, Artificial Sequence; identical to SEQ ID NO: 185693
  derived and/or modified sequence opt5 from hemagglutinin__InfluenzaA__ACT86039

SEQ ID NO: 186110 - RNA, 1701 nt, Artificial Sequence; identical to SEQ ID NO: 185693
  derived and/or modified sequence opt5 from hemagglutinin__InfluenzaA__ACT86059

SEQ ID NO: 186111 - RNA, 1701 nt, Artificial Sequence; identical to SEQ ID NO: 185693
  derived and/or modified sequence opt5 from hemagglutinin__InfluenzaA__ACT86069

SEQ ID NO: 186112 - RNA, 1701 nt, Artificial Sequence; identical to SEQ ID NO: 185693
  derived and/or modified sequence opt5 from hemagglutinin__InfluenzaA__ACT86079

SEQ ID NO: 186113 - RNA, 1701 nt, Artificial Sequence; identical to SEQ ID NO: 185693
  derived and/or modified sequence opt5 from hemagglutinin__InfluenzaA__ACT86089

SEQ ID NO: 186114 - RNA, 1701 nt, Artificial Sequence; identical to SEQ ID NO: 185693
  derived and/or modified sequence opt5 from hemagglutinin__InfluenzaA__ACT86099

SEQ ID NO: 186115 - RNA, 1701 nt, Artificial Sequence; identical to SEQ ID NO: 185935
  derived and/or modified sequence opt5 from hemagglutinin__InfluenzaA__ACT86109

SEQ ID NO: 186116 - RNA, 1701 nt, Artificial Sequence; identical to SEQ ID NO: 185693
  derived and/or modified sequence opt5 from hemagglutinin__InfluenzaA__ACT86119

SEQ ID NO: 186117 - RNA, 1701 nt, Artificial Sequence; identical to SEQ ID NO: 185935
  derived and/or modified sequence opt5 from hemagglutinin__InfluenzaA__ACT86129

SEQ ID NO: 186118 - RNA, 1701 nt, Artificial Sequence; identical to SEQ ID NO: 185693
  derived and/or modified sequence opt5 from hemagglutinin__InfluenzaA__ACT86139

SEQ ID NO: 186119 - RNA, 1701 nt, Artificial Sequence
  derived and/or modified sequence opt5 from hemagglutinin__InfluenzaA__ACU00932
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaauuuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186120 - RNA, 1701 nt, Artificial Sequence; identical to SEQ ID NO: 185693
  derived and/or modified sequence opt5 from hemagglutinin__InfluenzaA__ACU00942

SEQ ID NO: 186121 - RNA, 1701 nt, Artificial Sequence; identical to SEQ ID NO: 185693
  derived and/or modified sequence opt5 from hemagglutinin__InfluenzaA__ACU00952

SEQ ID NO: 186122 - RNA, 1701 nt, Artificial Sequence
  derived and/or modified sequence opt5 from hemagglutinin__InfluenzaA__ACU12494
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuauuaacgaagacuucaauuggaccggaguggcucagucuggcgaguccuaugccugcaagcggggcagcgucaagucuuucuucucccgccucaacuggcugcacgagagcgauuacaaauauccugcgcuuaaugugacaaugcccaacaaugggaaguuugacaaacuguacaucuggggaguucaucacccuauuaccgauagagaacaaacaucucucuacgugcgggccuccggccgcgucaccgugagcacgaagagaucccagcagacagugaucccgaacauugggucucggcccuggguccgcggacugagcuccagaaucagcauuuauuggaccaucguuaaaccuggcgacauccugcucauuaauucuacagggaaccugaucgcuccccggggauacuucaagauucgcaccggcaaguccagcaucaugagaucugacgccccuauuggcaccuguagcuccgagugcaucacacccaacgggucuaucccgaaugauaaaccuuuucagaacgugaaucggauuacguauggagcuuguccccgcuacgugaagcaaaacacccuuaaacuggccacaggcaugagaaaugucccugaaaagcagacccgggggaucuucggagcgauugccggcuuuaucgagaacgggugggagggaaugguggacggcugguauggcuucagacaccagaauagcgaagggacaggacaggcugccgaucucaaauccacccaagcugccauugaccagaucaacggcaagcugaaucgccuuaucgagaaaacgaacgaaaaguuucaucagauugagaaggaauuuagcgagguugaggggcggauccaagaucuggaaaaauacguggaggacacaaagauugaucucuggucuuauaaugccgaacugcuggucgcucucgagaaccagcacaccaucgaccugaccgauuccgaaaugaauaaacuuuucgagaagacaagaaaacagcugcgcgagaacgcggaagacaugggaaauggcugcuuuaagauuuaccauaagugugauaacgccugcaucgggagcauucggaacggcaccuacgaccacgacguguauagagaugaggcucucaauaaccgcuuccagaucaaaggaguugaacugaagucuggcuacaaagacuggauccuuuggauuuccuuugccaucagcugcuuccugcucugugugguccugcugggguuuauuaugugggccugccaaaagggaaauauccgguguaacauuugcaucuga

SEQ ID NO: 186123 - RNA, 1698 nt, Artificial Sequence; identical to SEQ ID NO: 185805
  derived and/or modified sequence opt5 from hemagglutinin__InfluenzaA__ACU12505

SEQ ID NO: 186124 - RNA, 1701 nt, Artificial Sequence
  derived and/or modified sequence opt5 from hemagglutinin__InfluenzaA__ACU12516
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccuggucgacgcccuccugggcgauccccagugcgacggguuucaaaacaaaaagugggaucuguucguggaaagaagcaaagccuauuccaauuguuacccuuaugacguucccgauuacgcuucucuccggagccugguggccuccagcggaacgcuugaguuuaacaaugaaucuuucaacuggaccggcgucacacagaauggcaccuccagcgcuugcaagcgcagaucuaacaauuccuuuuucagccggcugaacuggcucacacaucugaaguuuaaauauccugcccuuaaugugaccaugcccaacaacgagaaguucgacaaacuguacauuuggggaguucaccauccugggacggauaaugaccagaucucucucuaugcgcaggccuccggccgcauuacagugagcaccaagagaucccaacagacagucaucccgaacauugggucucggccccgcgugagagauaucagcucccggauuagcaucuacuggaccaucgugaaaccuggagacauucugcugaucaauucuaccggcaaccucauugcuccccgcggguacuuuaagaucagauccggaaagagcucuauuaugcggagcgacgccccuaucggcaaauguaauuccgagugcaucacacccaacggcucuauuccgaaugauaagccuuuccagaacgucaaucgcaucacguauggggcuugucccagauacguuaaacagaacacccugaaacuugccacaggaaugcggaaugugccugaaacccaaacacgcggcauuuuuggggcgaucgccggauucauugagaacggcugggaagggaugguggacggaugguauggcuuuagacaccagaauagcgagggcaccgggcaggcugccgaucugaaguccacgcaagcugccaucaaccagaucaauggaaagcucaaccggcugauuggcaaaacaaacgagaaguuccaccagaucgaaaaggaguucagcgaagucgaggggcgcauucaggaccuugaaaaauacguggaggauaccaagaucgaccuguggucuuauaaugccgagcuccugguugcucuggaaaaccaacauaccauugaucucacagacuccgagaugaauaaacuguuugaaagaaccaagaaacagcuucgggagaacgcggaagauaugggaaauggcugcuucaagaucuaccacaagugugacaacgccugcauugggagcaucagaaauggcacauaugaucaugacguguaccgcgacgaggcucugaacaaucgguuucagaucaaaggagucgagcucaagucuggcuacaaagauuggauucuguggaucuccuucgccauuagcugcuuucuucuguguguggcccuccugggguucaucaugugggcuugccagaagggaaacauuagauguaauaucugcaucuga

SEQ ID NO: 186125 - RNA, 1701 nt, Artificial Sequence; identical to SEQ ID NO: 183654
  derived and/or modified sequence opt5 from hemagglutinin__InfluenzaA__ACU12527

SEQ ID NO: 186126 - RNA, 1701 nt, Artificial Sequence; identical to SEQ ID NO: 185396
  derived and/or modified sequence opt5 from hemagglutinin__InfluenzaA__ACU12538

SEQ ID NO: 186127 - RNA, 1701 nt, Artificial Sequence; identical to SEQ ID NO: 184592
  derived and/or modified sequence opt5 from hemagglutinin__InfluenzaA__ACU12549

SEQ ID NO: 186128 - RNA, 1698 nt, Artificial Sequence
  derived and/or modified sequence opt5 from hemagglutinin__InfluenzaA__ACU12560
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaaggaaaggaggugcugguccucuggggcgugcaccacccuccgaacaucggggaccagaauacccuguaccauacagaaaacgccuacgugagcgucguuuccucucacuauagcagaaaauucacccccgagauugcuaagcggccuaaggugcgcgaucaggaaggaagaaucaauuacuauuggacgcuucuggagcccggcgacacaauuaucuuugaggccaacgggaaucucauugcgccucgguacgccuucgcucugucccgcggauuuggcagcggcaucauuaacucuaaugugcccauggauaaaugugacgccaagugccagaccccgcaaggggcuaucaacuccagccuuccuuuccagaauguccaucccgugacaaucggagaauguccuaaauauguuagaucugccaagcugcggauggugaccggccuccgcaacauucccagcauccaguccagagggcuguuuggagcgauugccggcuucaucgaagggggauggaccggcauggucgauggcugguacggguaucaccaccagaaugaacaaggaucuggcuacgcugccgaccagaaaagcacacagaacgcuauuaaugggaucacgaacaagguuaauuccgugaucgagaaaaugaacacccaguuuacagccgugggaaaggaguucaacaagcuggagcggcgcauggagaaucucaacaaaaaggucgaugacggcuucauugauaucuggaccuacaaugccgaacugcuugugcugcucgagaacgaaagaacacuggacuuucaugacagcaaugucaaaaaccuuuaugagaaggugaaaucucaacugaagaauaacgcuaaggaaauugggaauggcugcuucgaguuuuaccacaaauguaacgaugagugcauggaauccguuaagaauggaaccuaugacuaccccaaauauagcgaggaaucuaagcucaaccgggagaaaaucgauggcgugaagcuggaguccaugggggucuaccagauucuggcgaucuauagcacgguggccuccucucucguucugcuugugagccugggagcuaucuccuucuggaugugcucuaauggcagccuccagugucgcauuugcaucuga

SEQ ID NO: 186129 - RNA, 1698 nt, Artificial Sequence; identical to SEQ ID NO: 185512
  derived and/or modified sequence opt5 from hemagglutinin__InfluenzaA__ACU12571

SEQ ID NO: 186130 - RNA, 1698 nt, Artificial Sequence
  derived and/or modified sequence opt5 from hemagglutinin__InfluenzaA__ACU12582
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggagauuugccgauuacgaggaacugcgggagcaacucuccucugucagcuccuucgaacgcuuugagaucuuccccaaggagagcucuuggccuaaccauacggugaccggaguuuccgccagcugcucucacaauggcgaauccagcuuuuauagaaaccugcuuuggcugacaggcaaaaaugggcucuaccccaaccugucuaaguccuaugcuaauaacaaaggaaaggaggugcugguccucuggggcgugcaucacccuccgaacaucggggaccagaauacccuguaccacacagaaaacgccuacgugagcgucguuuccucucauuauagccggaaauucacccccgagauugcuaagcgcccuaaggugagagaucaggaaggacggaucaauuacuauuggacgcuucuggagcccggcgacacaauuaucuuugaggccaacgggaaucucauugcgccucgcuacgccuucgcucuguccagaggauuuggcagcggcaucauuaacucuaaugcccccauggauaaaugugacgcuaagugccagaccccgcaaggggccaucaacuccagccuuccuuuccagaaugugcaccccgucacaaucggagaauguccuaaauaugugcggucugcgaagcugcgcaugguuaccggccucagaaacauucccagcauccagucccgggggcuguuuggagccauugcuggcuucaucgaagggggauggaccggcaugguggauggcugguacggguaucaucaccagaaugaacaaggaucuggcuacgccgcugaccagaaaagcacacagaacgccauuaaugggaucacgaacaaggucaauuccgugaucgagaaaaugaacacccaguuuacagccguuggaaaggaguucaacaagcuggagcgcagaauggagaaucucaacaaaaagguggaugacggcuucauugauaucuggaccuacaaugcugaacugcuuguccugcucgagaacgaacggacacuggacuuucacgacagcaaugugaaaaaccuuuaugagaaggucaaaucucaacugaagaauaacgcgaaggaaauugggaauggcugcuucgaguuuuaccauaaauguaacgaugagugcauggaauccgugaagaauggaaccuaugacuaccccaaauauagcgaggaaucuaagcucaaccgcgagaaaaucgauggcguuaagcuggaguccauggggguguaccagauucuggccaucuauagcacggucgcuuccucucucgugcugcuuguuagccugggagccaucuccuucuggaugugcucuaauggcagccuccaguguagaauuugcaucuga

SEQ ID NO: 186131 - RNA, 1698 nt, Artificial Sequence
  derived and/or modified sequence opt5 from hemagglutinin__InfluenzaA__ACU12593
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccagaaguccacacagaaugccauugauggaaucacgaacaaagugaauagcguuaucgaaaagaugaacacccaguuuacagccgugggcaaggaguucaauaaacuggagcgcagaauggaaaaccucaacaagaaagucgacgauggguucauugacaucuggaccuacaaugcugagcugcuugugcugcucgaaaacgagcggacacuggacuuucacgauagcaaugucaagaaccuuuaugaaaaagugaagucucaacugaagaauaacgcgaaagagauuggaaauggcugcuucgaguuuuaccauaaguguaacgacgaaugcauggaguccguuaaaaaugggaccuaugauuaccccaaguauagcgaagagucuaaacucaaccgcgagaagaucgacggcauuaagcuggaauccaugggaguguaccagauccuggccaucuauagcacggucgcuuccucucucgugcugcuuguuagccugggcgccauuuccuucuggaugugcucuaaugggagccuccaguguagaaucugcauuuga

SEQ ID NO: 186132 - RNA, 1701 nt, Artificial Sequence; identical to SEQ ID NO: 185693
  derived and/or modified sequence opt5 from hemagglutinin__InfluenzaA__ACU13090

SEQ ID NO: 186133 - RNA, 1701 nt, Artificial Sequence; identical to SEQ ID NO: 185693
  derived and/or modified sequence opt5 from hemagglutinin__InfluenzaA__ACU13091

SEQ ID NO: 186134 - RNA, 1701 nt, Artificial Sequence; identical to SEQ ID NO: 185693
  derived and/or modified sequence opt5 from hemagglutinin__InfluenzaA__ACU13092

SEQ ID NO: 186135 - RNA, 1701 nt, Artificial Sequence; identical to SEQ ID NO: 185693
  derived and/or modified sequence opt5 from hemagglutinin__InfluenzaA__ACU13093

SEQ ID NO: 186136 - RNA, 1701 nt, Artificial Sequence
  derived and/or modified sequence opt5 from hemagglutinin__InfluenzaA__ACU13094
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgggcaggagggaagaaugaauuacuauuggacacugguugaacccggcgauaagauuaccuucgaggccacggggaaccugguggugccucgguacgcguuugccauggaacgcaacgcuggauccggcaucauuaucagcgacacacccguccaugauugcaauaccacaugucaaaccccuaaaggcgccaucaacaccucucuccccuuccagaauauucacccgaucacaauugggaagugcccuaaguaugugaaaagcacgaagcugagacuugcuaccggacugcggaacguucccuccauccagucucgcggccucuuuggggccauugccggauucaucgagggcggguggacaggaaugguggacggcugguacggcuaucaucaccagaaugaacaagggagcggauacgcugcggaccugaaauccacccagaacgccaucgaugagauuacaaauaaggucaacagcgugaucgagaaaaugaauacccaguuuacggcuguuggcaaggaguucaaccaccuugagaagagaauugaaaaucugaacaaaaagguggacgauggguuccucgacaucuggacauacaaugccgagcugcugguccuccuggaaaacgagcggacccuugauuaucaugacucuaaugugaaaaaccuguacgagaagguccgcucccagcucaaaaacaaugccaaggaaauuggaaacggcuguuuugaguucuaucacaagugcgauaauaccuguauggaaagcgugaaaaacgggacauacgacuauccuaaguacucugaggaagcuaaacugaauagagaggagaucgauggcguuaaacuugaauccacccggaucuaucaaauucuggccaucuacagcacaguggcguccucucucguccuggugguuagccugggagcuauuuccuuuuggaugugcucuaacggcagccuccagugccgcaucuguauuuga

SEQ ID NO: 186137 - RNA, 1701 nt, Artificial Sequence; identical to SEQ ID NO: 185693
  derived and/or modified sequence opt5 from hemagglutinin__InfluenzaA__ACU13095

SEQ ID NO: 186138 - RNA, 1701 nt, Artificial Sequence
  derived and/or modified sequence opt5 from hemagglutinin__InfluenzaA__ACU13096
augaaggccauccuggugguccuccugcacaccuucgcuacagccaacgcggacacgcuuugcauuggcuaccaugcuaauaacagcaccgauacaguugacaccgugcuggagaaaaaugugacagucacccacuccgugaaccuccuggaagauaagcauaaugggaaacuuuguaagcugagaggaguugcuccccuccaccugggcaaaugcaacaucgccggguggauucugggaaauccugagugugaaucucucagcacagccuccucuuggagcuauaucguggagaccuccucuagcgacaacggcacgugcuacccgggggauuuuauugacuaugaagaacugcgggagcagcuuuccagcgucucuuccuucgaacgcuuugagaucuuccccaagaccagcucuuggccuaaucaugauuccaacaagggagugacagccgcuuguccccacgccggcgcgaaaucuuuuuacaagaaucugaucuggcucguuaaaaagggcaacagcuauccuaaacuguccaagagcuacauuaaugacaaggggaaagaagugcuuguccuguggggaauccaccaucccuccaccucugccgaucaacagagccucuaucagaacgcugacgccuacguguucgugggcuccagcagauacucuaagaaauuuaagccugagauugcuauccggccgaaaguccgcgaucaggaggggagaaugaauuauuacuggacacugguugaacccggagacaagauuaccuucgaggccacgggcaaccugguggugccucgguaugcguuugccauggaacgcaacgcuggguccggaaucauuaucagcgauacacccguccacgacugcaauaccacaugucaaaccccuaaaggcgccaucaacaccucucuccccuuccagaauauucauccgaucacaauuggcaagugcccuaaguacgugaaaagcacgaagcugagacuugcuaccgggcugcggaacguucccuccauccagucucgcggacucuuuggcgccauugccggguucaucgagggaggcuggacagggaugguggacggaugguauggcuaccaccaccagaaugaacaaggcagcggguaugcugcggaucugaaauccacccagaacgccaucgacgagauuacaaauaaggucaacagcgugaucgagaaaaugaauacccaguuuacggcuguuggaaaggaguucaaccaucuugagaagagaauugaaaaucugaacaaaaagguggaugacggcuuccucgauaucuggacauacaaugccgagcugcugguccuccuggaaaacgagcggacccuugacuaccacgauucuaaugugaaaaaccuguaugagaagguccgcucccagcucaaaaacaaugccaaggaaauugggaacggauguuuugaguucuaccauaagugcgacaauaccuguauggaaagcgugaaaaacggcacauaugauuacccuaaguauucugaggaagcuaaacugaauagagaggagaucgacgggguuacccuugaauccacacggaucuaccaaauucuggccaucuauagcacgguggcguccucucucguccuggugguuagccugggcgcuauuuccuuuuggaugugcucuaacggaagccuccagugccgcaucuguauuuga

SEQ ID NO: 186139 - RNA, 1701 nt, Artificial Sequence; identical to SEQ ID NO: 185693
  derived and/or modified sequence opt5 from hemagglutinin__InfluenzaA__ACU13098

SEQ ID NO: 186140 - RNA, 1701 nt, Artificial Sequence
  derived and/or modified sequence opt5 from hemagglutinin__InfluenzaA__ACU13099
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacucuaucacgauuggcaagugcccgaaguaugugaaaagcaccaagcugagacuugcuacagggcugcggaacguuccuuccauccagucucgcggacucuuuggcgccauugccggguucaucgaaggaggcuggaccgggaugguggacggaugguacggcuaucaucaccagaaugagcaaggcagcggguacgcugcggaccugaaauccacacagaacgccaucgaugagauuaccaauaaggucaacagcgugaucgaaaagaugaauacgcaguuuacagcuguuggaaaggaguucaaccaccuugaaaagagaauugagaaucugaacaaaaagguggacgauggcuuccucgacaucuggaccuacaaugccgaacugcugguccuccuggagaacgagcggacccuugauuaucaugacucuaaugugaaaaaccuguacgaaaagguccgcucccagcucaaaaacaaugccaaggagauugggaacggauguuuugaguucuaucacaagugcgauaauacauguauggagagcgugaaaaacggcaccuacgacuaucccaaguacucugaagaggcuaaacugaauagagaggaaaucgaugggguuaaacuugaguccacacggaucuaucaaauucuggccaucuacagcacgguggcguccucucucguccuggugguuagccugggcgcuauuuccuuuuggaugugcucuaacggaagccuccagugccgcaucuguauuuga

SEQ ID NO: 186141 - RNA, 1701 nt, Artificial Sequence
  derived and/or modified sequence opt5 from hemagglutinin__InfluenzaA__ACU13129
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgagcaggaagggagaaugaauuacuauuggacccugguugagcccggagauaagauuacguucgaagccacaggcaaccugguggugccucgguacgcguuugccauggagcgcaacgcugggucuggaaucauuaucuccgacacccccguccaugauugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaccugaaaagcacacagaacgccaucgaugagauuaccaauaaggucaacuccgugaucgagaaaaugaauacgcaguuuacagcuguuggagaggaguucaaccaccuugaaaagagaauugaaaaucugaacaagaaaguggacgauggcuuccucgacaucuggaccuacaaugccgagcugcugguccuccuggagaacgaacggacccuugauuaucaugacagcaaugugaagaaccuguacgagaaaguccgcucucagcucaagaacaaugccaaagaaauugggaacggauguuuugaguucuaucacaagugcgauaauacauguauggaauccgugaagaacggcaccuacgacuauccuaaauacagcgaggaggcuaagcugaauagagaagagaucgaugggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186142 - RNA, 1701 nt, Artificial Sequence; identical to SEQ ID NO: 185693
  derived and/or modified sequence opt5 from hemagglutinin__InfluenzaA__ACU16795

SEQ ID NO: 186143 - RNA, 1701 nt, Artificial Sequence; identical to SEQ ID NO: 185693
  derived and/or modified sequence opt5 from hemagglutinin__InfluenzaA__ACU16858

SEQ ID NO: 186144 - RNA, 1701 nt, Artificial Sequence; identical to SEQ ID NO: 185693
  derived and/or modified sequence opt5 from hemagglutinin__InfluenzaA__ACU16930

SEQ ID NO: 186145 - RNA, 1701 nt, Artificial Sequence; identical to SEQ ID NO: 185693
  derived and/or modified sequence opt5 from hemagglutinin__InfluenzaA__ACU16993

SEQ ID NO: 186146 - RNA, 1701 nt, Artificial Sequence; identical to SEQ ID NO: 185693
  derived and/or modified sequence opt5 from hemagglutinin__InfluenzaA__ACU17059

SEQ ID NO: 186147 - RNA, 1701 nt, Artificial Sequence; identical to SEQ ID NO: 185693
  derived and/or modified sequence opt5 from hemagglutinin__InfluenzaA__ACU17126

SEQ ID NO: 186148 - RNA, 1701 nt, Artificial Sequence; identical to SEQ ID NO: 185784
  derived and/or modified sequence opt5 from hemagglutinin__InfluenzaA__ACU17187

SEQ ID NO: 186149 - RNA, 1701 nt, Artificial Sequence; identical to SEQ ID NO: 185693
  derived and/or modified sequence opt5 from hemagglutinin__InfluenzaA__ACU17258

SEQ ID NO: 186150 - RNA, 1701 nt, Artificial Sequence
  derived and/or modified sequence opt5 from hemagglutinin__InfluenzaA__ACU17389
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccgccugucaaacaccuaagggcgcuaucaacaccucucuccccuuccacaauauucauccgaucaccauuggcaaaugcccuaaguauguuaagagcacaaaacugagacuugccacggggcugcggaacgugcccuccauccagucucgcggacucuuuggcgccauugcuggguucaucgaaggaggcuggaccgggaugguggacggaugguacggcuaucaccaccagaaugagcagggcagcggguacgcggccgaucugaaguccacacaaaacgcuaucgacgagauuaccaauaaagucaacagcgugaucgaaaagaugaauacacaguuuaccgccguuggaaaagaguucaaccaucuugaaaagagaauugagaaucugaacaagaaaguggaugacggcuuccucgauaucuggacguacaaugccgaacugcugguccuccuggagaacgagcggacacuugacuaucacgauucuaaugugaagaaccuguacgaaaaaguccgcucccagcucaagaacaaugcuaaagagauugggaacggauguuuugaguucuaucauaagugcgacaauaccuguauggaaagcgugaagaacggcaccuacgauuauccuaaauacucugaagaggccaagcugaauagagaggaaaucgacgggguuaaacuugaguccacacggaucuaucagauucuggcgaucuacagcaccguggcuuccucucucguccuggugguuagccugggcgccauuuccuuuuggaugugcucuaacggaagccuccaaugccgcaucuguauuuga

SEQ ID NO: 186151 - RNA, 1701 nt, Artificial Sequence; identical to SEQ ID NO: 185693
  derived and/or modified sequence opt5 from hemagglutinin__InfluenzaA__ACU17450

SEQ ID NO: 186152 - RNA, 1701 nt, Artificial Sequence; identical to SEQ ID NO: 185693
  derived and/or modified sequence opt5 from hemagglutinin__InfluenzaA__ACU17521

SEQ ID NO: 186153 - RNA, 1701 nt, Artificial Sequence; identical to SEQ ID NO: 185680
  derived and/or modified sequence opt5 from hemagglutinin__InfluenzaA__ACU27041

SEQ ID NO: 186154 - RNA, 1698 nt, Artificial Sequence
  derived and/or modified sequence opt5 from hemagglutinin__InfluenzaA__ACU27406
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaaaucagagaucaggagggccggauuaacuacuauuggacgcuucuggagcccggggacacaaucauuuuugaagccaauggaaaccucaucgcgccucgcuacgccuucgcucuguccagaggcuuugggagcggaauuaucaauucuaacgcccccauggauaagugugacgcuaaaugccagaccccgcaaggcgccaucaauuccagccuuccuuuccagaacgugcaccccgucacaauuggcgaguguccuaaguaugugcggucugcgaaacugcgcaugguuaccgggcucagaaauauccccagcauucagucccggggacuguuuggcgccaucgcuggguucauugaaggaggcuggaccgggaugguggauggaugguacggcuaucaucaccagaacgagcaaggcucuggguacgccgcugaccaaaagagcacacagaaugccaucaacggaaucacgaauaaagucaacuccgugauugaacgcaugaauacccaguuuacagccguuggcaaggaguucaacaagcuggagagacggauggaaaaccucaauaaaaagguggaugacggguucaucgauauuuggaccuacaacgcugagcugcuuguccugcucgaaaaugagcgcacacuggacuuucacgacagcaacgugaaaaaucuuuaugaaaaggucaaaucucagcugaagaacaaugcgaaggagaucggaaacggcugcuucgaguuuuaccauaaauguaaugaugaaugcauggaguccgugaagaacgggaccuaugacuaccccaaauauagcgaagagucuaagcucaauagagagaaaauugauggcguuaagcuggaauccaugggaguguaccagauccuggccaucuauagcacggucgcuuccucucucgugcugcuuguuagccugggcgccauuuccuucuggaugugcucuaacgggagccuccagugucggaucugcauuuga

SEQ ID NO: 186155 - RNA, 1698 nt, Artificial Sequence
  derived and/or modified sequence opt5 from hemagglutinin__InfluenzaA__ACU27407
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucacgacagcaacgucaagaaucuuuaugaaaaagugaagucucagcugaagaacaaugcgaaagagauuggaaacggcugcuucgaguuuuaccauaaguguaaugaugaaugcauggaguccguuaaaaacgggaccuaugacuaccccaaguauagcgaagagucuaaacucaaucgcgagaagaucgauggcgugaagcuggaauccaugggagucuaccagauucuggccaucuauagcacgguggcuuccucucucguucugcuugugagccugggcgccaucuccuucuggaugugcucuaacgggagccuccaguguagaauuugcaucuga

SEQ ID NO: 186156 - RNA, 1701 nt, Artificial Sequence; identical to SEQ ID NO: 185680
  derived and/or modified sequence opt5 from hemagglutinin__InfluenzaA__ACU29949

SEQ ID NO: 186157 - RNA, 1701 nt, Artificial Sequence
  derived and/or modified sequence opt5 from hemagglutinin__InfluenzaA__ACU29979
augaaggccauccuggugguccuccuguacaccuucgcugccgcgaacgcugacacacuuugcauuggcuaucacgccaauaacagcacggauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacauccucuagcgacaacgggaccugcuauccgggcgauuuuauugacuacgaagaacugcgggagcagcuuuccagcgucucuuccuucgaacgcuuugagaucuuccccaagacgagcucuuggccuaaucacgauuccaacaagggagugaccgcugccuguccccaugcgggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcugaucaacagagccucuaccagaacgccgacgcuuacguguucgugggcaccuccagauauagcaagaaauuuaagccugagauugccauccggccgaaaguccgcgaucaggaggggagaaugaauuacuauuggacacugguugaacccggagacaagauuaccuucgaggcgacgggcaaccugguggugccucgguacgccuuugcuauggaacgcaacgccgggucuggaaucauuaucuccgauacacccguccaugacugcaauaccacaugucaaaccccuaaaggcgcuaucaacaccagccuccccuuccagaauauucacccgaucacaauuggcaagugcccuaaguaugugaaaucuacgaagcugagacuugccaccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacgagauuacaaauaaggucaacuccgugaucgagaaaaugaauacccaguuuacggccguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 186158 - RNA, 1701 nt, Artificial Sequence; identical to SEQ ID NO: 185693
  derived and/or modified sequence opt5 from hemagglutinin__InfluenzaA__ACU29989

SEQ ID NO: 186159 - RNA, 1704 nt, Artificial Sequence
  derived and/or modified sequence opt5 from hemagglutinin__InfluenzaA__ACU29999
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccugcagugccgcaucuguauuuga

SEQ ID NO: 186160 - RNA, 1704 nt, Artificial Sequence
  derived and/or modified sequence opt5 from hemagglutinin__InfluenzaA__ACU30009
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuauccuaaauacucugaagaggcuaagcugaauagagaggaaaucgacgggguuaaacuugaguccacccggaucuaucagauucuggccaucuacagcacaguggcguccucucucguccuggugguuagccugggcgcuauuuccuuuuggaugugcucuggauacggcagccuccaaugccgcaucuguauuuga

SEQ ID NO: 186161 - RNA, 1701 nt, Artificial Sequence; identical to SEQ ID NO: 186053
  derived and/or modified sequence opt5 from hemagglutinin__InfluenzaA__ACU30019

SEQ ID NO: 186162 - RNA, 1701 nt, Artificial Sequence; identical to SEQ ID NO: 185873
  derived and/or modified sequence opt5 from hemagglutinin__InfluenzaA__ACU30093

SEQ ID NO: 186163 - RNA, 1701 nt, Artificial Sequence
  derived and/or modified sequence opt5 from hemagglutinin__InfluenzaA__ACU30103
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuaccauuggacccugguugaacccggagacaagauuacguucgaggccacaggcaaccugguggugccucgguaugcguuugccauggaacgcaacgcugggucuggaaucauuaucuccgauacccccguccacgacugcaauacaaccugucaaaccccuaaaggcgccaucaacacaagccuccccuuccagaauauucauccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaccaccagaaugaacaaggcucuggguaugcugcggaucugaaaagcacacagaacgccaucgacgagauuaccaauaaggucaacuccgugaucgagaaaaugaauacgcaguuuacagcuguuggaaaggaguucaaccaucuugagaagagaauugaaaaucugaacaaaaagguggaugacggcuuccucgauaucuggaccuacaaugccgagcugcugguccuccuggaaaacgagcggacccuugacuaccacgauagcaaugugaaaaaccuguaugagaagguccgcucucagcucaaaaacaaugccaaggaaauugggaacggauguuuugaguucuaccauaagugcgacaauacauguauggaauccgugaaaaacggcaccuaugauuacccuaaguauagcgaggaagcuaaacugaauagagaggagaucgacgggguuaaacuugaaucuacacggaucuaccaaauucuggccaucuauuccacgguggcgagcucccucguccuggugguuucucugggcgcuauuagcuuuuggaugugcuccaacggaucucuccagugccgcaucuguauuuga

SEQ ID NO: 186164 - RNA, 1704 nt, Artificial Sequence
  derived and/or modified sequence opt5 from hemagglutinin__InfluenzaA__ACU30112
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcucccagcucaagaacaaugccaaagagauugggaacggauguuuugaguucuaucauaagugcgacaauaccuguauggaaagcgugaagaacggcacauacgauuauccuaaauacucugaagaggcuaagcugaauagagaggaaaucgacgggguuaaacuugaguccacccggaucuaucagauucuggccaucuacagcacaguggcguccucucucguccuggugguuagccugggcgcuauuuccuuuuggaugugcucucacauggugcuccugcaaugccgcaucuguauuuga

SEQ ID NO: 186165 - RNA, 1701 nt, Artificial Sequence
  derived and/or modified sequence opt5 from hemagglutinin__InfluenzaA__ACU30121
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaaagagaauugagaaucugaacaagaaaguggaugacggcuuccucgauaucuggacauacaaugccgaacugcugguccuccuggagaacgagcggacccuugacuaucacgauucuaaugugaagaaccuguacgaaaaaguccgcaaccagcucaagaauaacgccaaagagauugggaauggauguuuugaguucuaucauaagugcgacaacaccuguauggaauccgugaagaauggcacauacgauuauccuaaauacagcgaagaggcuaagcugaacagagaggaaaucgacgggguuaaacuugagucuacccggaucuaucagauucuggccaucuacuccacaguggcgagcucccucguccuggugguuucucugggcgcuauuagcuuuuggaugugcuccaauggaucucuccaaugccgcaucuguauuuga

SEQ ID NO: 186166 - RNA, 1701 nt, Artificial Sequence; identical to SEQ ID NO: 185786
  derived and/or modified sequence opt5 from hemagglutinin__InfluenzaA__ACU31124

SEQ ID NO: 186167 - RNA, 1701 nt, Artificial Sequence; identical to SEQ ID NO: 185725
  derived and/or modified sequence opt5 from hemagglutinin__InfluenzaA__ACU31143

SEQ ID NO: 186168 - RNA, 1701 nt, Artificial Sequence; identical to SEQ ID NO: 185725
  derived and/or modified sequence opt5 from hemagglutinin__InfluenzaA__ACU31144

SEQ ID NO: 186169 - RNA, 1701 nt, Artificial Sequence; identical to SEQ ID NO: 185725
  derived and/or modified sequence opt5 from hemagglutinin__InfluenzaA__ACU31145

SEQ ID NO: 186170 - RNA, 1701 nt, Artificial Sequence; identical to SEQ ID NO: 185873
  derived and/or modified sequence opt5 from hemagglutinin__InfluenzaA__ACU31146

SEQ ID NO: 186171 - RNA, 1701 nt, Artificial Sequence; identical to SEQ ID NO: 185693
  derived and/or modified sequence opt5 from hemagglutinin__InfluenzaA__ACU31147

SEQ ID NO: 186172 - RNA, 1701 nt, Artificial Sequence
  derived and/or modified sequence opt5 from hemagglutinin__InfluenzaA__ACU31148
augaaggccauccuggugauuaugcucuacaccuucgcuacagccaacgcggacacgcugugcaucggcuaucacgcuaauaacagcaccgauacagucgacaccguucuugagaaaaaugugacagugacccauuccgucaaccugcucgaagauaagcacaaugggaaacuguguaaacuuagaggaguggcuccccugcaucucggcaagugcaacauugccggguggauccugggaaauccugagugugaaucucugagcacagccuccucuuggagcuacauuguugagaccuccucuagcgacaacggcacgugcuauccgggggauuuuaucgacuacgaagaacuccgggagcagcuguccagcgugucuuccuucgaacgcuuugagaucuuccccaagaccagcucuuggccuaaucacgauuccaacaagggagucacagccgcuuguccccaugccggcgcgaaaucuuuuuauaagaaucuuauuuggcuggugaaaaagggcaacagcuacccuaaacucuccaagagcuauaucaaugacaaggggaaagaaguucuggugcuuuggggcauucaccaccccuccaccucugccgaucaacagagccuguaccagaacgcugacgccuacgucuucgugggauccagcagauauucuaagaaauuuaagccugagaucgcuauucggccgaaagugcgcgaucaggaggggagaaugaauuacuauuggacacucgucgaacccggagacaagaucaccuucgaggccacgggcaaccugguugugccucgguacgcguuugccauggaacgcaacgcuggguccggaauuaucaucagcgauacacccgugcaugacugcaauaccacaugucaaaccccuaaaggcgccauuaacaccucucugcccuuccagaauauccacccgauuacaaucggcaagugcccuaaguaugucaaaagcacgaagcucagacuggcuaccgggcuucggaacgugcccuccauucagucucgcggacuguuuggcgccaucgccggguucaucgagggaggcuggacagggaugguugacggaugguacggcuaucaucaccagaaugaacaaggcagcggguacgcugcggaucucaaauccacccagaacgccauugacgagaucacaaauaaggugaacagcgucauugagaaaaugaauacccaguuuacggcugugggaaaggaguucaaccaccuggagaagagaaucgaaaaucuuaacaaaaagguugaugacggcuuccuggauauuuggacauacaaugccgagcuccuggugcugcucgaaaacgagcggacccuggacuaucaugauucuaaugucaaaaaccuuuacgagaaggugcgcucccagcugaaaaacaaugccaaggaaaucgggaacggauguuuugaguucuaucacaagugcgacaauaccuguauggaaagcgucaaaaacggcacauacgauuauccuaaguacucugaggaagcuaaacucaauagagaggagaucgacggggugaagcuggaauccacccggauuuaucaaauccuugccauuuacagcacaguugcguccucucuggugcucgucgugagccugggcgcuaucuccuuuuggaugugcucuaacggaagccugcagugccgcauuuguaucuga

SEQ ID NO: 186173 - RNA, 1701 nt, Artificial Sequence; identical to SEQ ID NO: 185680
  derived and/or modified sequence opt5 from hemagglutinin__InfluenzaA__ACU31149

SEQ ID NO: 186174 - RNA, 1701 nt, Artificial Sequence; identical to SEQ ID NO: 185680
  derived and/or modified sequence opt5 from hemagglutinin__InfluenzaA__ACU31150

SEQ ID NO: 186175 - RNA, 1701 nt, Artificial Sequence; identical to SEQ ID NO: 185680
  derived and/or modified sequence opt5 from hemagglutinin__InfluenzaA__ACU31151

SEQ ID NO: 186176 - RNA, 1701 nt, Artificial Sequence; identical to SEQ ID NO: 185680
  derived and/or modified sequence opt5 from hemagglutinin__InfluenzaA__ACU31152

SEQ ID NO: 186177 - RNA, 1707 nt, Artificial Sequence
  derived and/or modified sequence opt5 from hemagglutinin__InfluenzaA__ACU46644
auggagaagaucgugcuccuguucgccauugucagccugguuaaauccgaccagaucugcauuggcuaccacgcuaacaauucuaccgaacaaguggauacaaucauggagaagaacgugacggucacccaugcccaggacauucuugaaaagacacacaaugggaagcugugugaucucgacggaggcaaaccccugauccuuagagauugccggguggcgggguggcugcucggaaacccuaugugugacgaguuuaucaauguuccggaauggagcuauauuguggagaaggcuaaccccgucaaugaucugugcuacccuggcgacuucaacgauuaugaggaacugaagcaucuccugucccgcaucaaucacuuugagaaaauucagaucauucccaagucuagcugguccucucaugaagccagccuugggguguccagcgccuguccuuaccagggaaaaucuuccuucuuuagaaacguuguguggcugaucaagaaaaauagcaccuaucccacaauuaagcggucuuacaacaauaccaaccaagaggaccuccugguccuuugguggauccaccacccuaaugaugcugccgagcagacaaagcuguaucagaacccgaccacguacaucuccgugggcaccagcacacucaaccagcgccuggugcccagaauugcuacccggucuaaagucaauggccaauccgggcgcauggaguucuuuuggacaauccugaagccuaacgacgccauuaauuucgaaagcaacggaaauuuuaucgcgcccgaauacgccuauaaaauuguuaagaaaggcgauuccaccaucaugaagucugagcucgaauacgggaacugcaauacgaaaugucagacaccuaugggagcuaucaacagcuccaugcccuuccaucacauucauccgcugaccaucggcgagugcccuaaguaugugaaaagcaauagacuugugcuggccacagggcuccggaacucuccccagcgcgagagacggcgcaaaaagagaggacuguuuggcgcuauugccggcuucaucgaagggggauggcagggcauggucgacgggugguacggauaucaccacuccaaugagcaaggcagcggguacgcggccgacaaagaaucuacccagaaggcuauugauggagugaccaacaaaguuaauagcaucaucgacaagaugaacacacaguuugaggccgugggccgggaguucaaucaucuugaacgcagaauugagaaccugaacaagaaaauggaagauggcuuccucgacgucuggacguauaaugcugagcugcuggugcucauggaaaacgagcggacccuggauuuucacgacuccaauguuaagaaccuuuacgauaaagugagacugcaacuccgcgacaaugccaaggaacuggggaacggauguuucgaguuuuaccauaaaugcgaugacgaguguauggaaucuguccggaauggcacauaugauuacccucaguauagcgaggaagccagacuuaagcgcgaggagaucuccggggugaagcuggaaagcauuggaaucuaccagauucucucuaucuauuccaccgucgcuagcucucuggcgcuggccauuaugguggcuggccucucccuguggaugugcagcaacgggucccuucagugccggaucuguaucuga

SEQ ID NO: 186178 - RNA, 1701 nt, Artificial Sequence
  derived and/or modified sequence opt5 from hemagglutinin__InfluenzaA__ACU56924
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggaaagaaacgcugggucuggaaucauuaucuccgauacccccguccaugacugcaauacaaccugucagaccccuaaaggcgccaucaacacaagccuccccuuccaaaauauucacccgaucacgauuggcaagugcccuaaguaugugaaaucuaccaagcugcggcuugcuacagggcugcgcaacguucccagcauccaguccagaggacucuuuggcgccauugccggguucaucgagggaggcuggaccgggaugguggacggaugguacggcuaucaucaccagaaugaacagggcucuggguacgcugcggaucugaaaagcacacaaaacgccaucgacgagauuaccaauaaggucaacuccgugaucgagaaaaugaauacgcaguuuacagcuguuggaaaggaguucaaccaccuugagaagcggauugaaaaucugaacaaaaagguggaugacggcuuccucgauaucuggaccuacaaugccgagcugcugguccuccuggaaaacgagcgcacccuugacuaucaugauagcaaugugaaaaaccuguacgagaaggucagaucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaaucgggaggagaucgacgggguuaaacuugaaucuacacgcaucuaucagauucuggccaucuacuccacgguggcgagcucccucguccuggugguuucucugggcgcuauuagcuuuuggaugugcuccaacggaucucuccaaugcagaaucuguauuuga

SEQ ID NO: 186179 - RNA, 1701 nt, Artificial Sequence; identical to SEQ ID NO: 186046
  derived and/or modified sequence opt5 from hemagglutinin__InfluenzaA__ACU56931

SEQ ID NO: 186180 - RNA, 1701 nt, Artificial Sequence; identical to SEQ ID NO: 185693
  derived and/or modified sequence opt5 from hemagglutinin__InfluenzaA__ACU64792

SEQ ID NO: 186181 - RNA, 1701 nt, Artificial Sequence; identical to SEQ ID NO: 185873
  derived and/or modified sequence opt5 from hemagglutinin__InfluenzaA__ACU64801

SEQ ID NO: 186182 - RNA, 1701 nt, Artificial Sequence; identical to SEQ ID NO: 185873
  derived and/or modified sequence opt5 from hemagglutinin__InfluenzaA__ACU64812

SEQ ID NO: 186183 - RNA, 1701 nt, Artificial Sequence; identical to SEQ ID NO: 185342
  derived and/or modified sequence opt5 from hemagglutinin__InfluenzaA__ACU79871

SEQ ID NO: 186184 - RNA, 1701 nt, Artificial Sequence; identical to SEQ ID NO: 185340
  derived and/or modified sequence opt5 from hemagglutinin__InfluenzaA__ACU79882

SEQ ID NO: 186185 - RNA, 1701 nt, Artificial Sequence; identical to SEQ ID NO: 185353
  derived and/or modified sequence opt5 from hemagglutinin__InfluenzaA__ACU79893

SEQ ID NO: 186186 - RNA, 1701 nt, Artificial Sequence; identical to SEQ ID NO: 185353
  derived and/or modified sequence opt5 from hemagglutinin__InfluenzaA__ACU79904

SEQ ID NO: 186187 - RNA, 1698 nt, Artificial Sequence
  derived and/or modified sequence opt5 from hemagglutinin__InfluenzaA__ACU79937
augaaggccaaacugcucgugcugcuuugcaccuucacagcuacguacgccgacaccaucuguauuggcuaucacgcgaacaauagcacagauaccgucgacacaguucuggagaagaacgugaccgugacacauuccgucaaucuccuggaagauucucacaacgggaaacuuugccugcucaagggaaucgcuccccugcagcugggcaauuguagcguggccggguggauucucggaaacccugagugcgaaucccugaucucuaaagagagcugguccuacauuguugaaaccccgaaucccgagaacggcacguguuauccuggguacuuugccgacuaugaggaacuuagagagcaacugucuagcguguccagcuucgaacgguuugagaucuuccccaaggagucuuccuggccuaaucauaccgucacaggagugaccgcuagcugcucucacaacggcaaguccagcuuuuaccgcaaucuccuguggcuuacagagaaaaacggccuguaucccaaucucucuaacuccuacguuaauaacaaggaaaaagaagugcugguccuguggggagugcaucacccuagcaacaucggggugcagagagccauuuaccacaccgagaaugcuuaugucuccguugugucuagccauuacucccggcgcuucacgccggaaaucgccaagagacccaaagugcggggccaggaggggcgcauuaacuauuacuggacacuccuggagccuggagauaccaucauuuuugaagcgaauggcaaccuuaucgcccccugguaugcuuucgcccugagcagaggguuuggaucuggcauuaucacauccaaugcuccuaugaacgagugugacgccaagugccagacaccccaaggcgcgaucaauagcucucucccguuccagaacguccacccugugaccauuggggaaugucccaaguacguucggagcaccaaacugcgcauggugacgggacuuagaaauaucccuuccauucagucucggggccuguuuggggccaucgcuggauucauugagggcggguggaccggaaugauggauggcugguauggcuaccaucaccagaacgaacaagggagcggauacgccgcugaccagaaguccacacagaaugccaucaacggcaucaccaauaaagucaacagcgugauugagaagaugaauacacaguuuaccgccguugggaaagaguucaacaagcucgaacgcagaauggagaaccugaauaaaaagguggaugacggauuccuggauaucuggacguauaacgcugaacuccugguccuucuggagaaugaacggacacucgacuuucacgauucuaacgugaagaaucuguacgagaaagucaagucccaacuuaaaaacaaugcgaaggagauuggcaacgggugcuucgaauuuuaucauaaauguaauaacgagugcauggaaagcgugaagaauggcaccuacgacuaucccaaguacucugaggaguccaaacugaaccgcgaaaagaucgacggaguuaaacucgagagcaugggcguguaucagauucuggccaucuacuccaccgucgcuucuagccuggugcuccugguuucccuuggggccaucucuuucuggaugugcagcaauggaucccugcaguguagaauuugcaucuga

SEQ ID NO: 186188 - RNA, 1689 nt, Artificial Sequence
  derived and/or modified sequence opt5 from hemagglutinin__InfluenzaA__ACU79948
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccgacuauccugucgcuaagggcagcuacaacaauaccucuggggagcagaugcugaucauuuggggagugcaccacccgaacgaugagacagaacagcggacccucuaucagaauguuggcacauacguguccgucgggaccagcacgcugaacaagcgcucuacacccgagaucgccaccagaccuaaagugaauggacaaggcggccggauggaauuuuccuggacacugcucgacaugugggauaccauuaacuucgagagcaccgggaaccugaucgcucccgaauacggauuuaagaucucuaaacgcggcuccagcgggauuaugaagacagagggaacgcuugagaauugcgaaaccaaaugucagacaccucugggcgccaucaacaccacacuccccuuccauaaugugcacccgcugaccauuggggagugcccuaaguaugucaaauccgaaaaacuuguucuggcgacgggacucagaaacgugccccagaucgagucucggggccuguuuggcgccauugcuggguucaucgaaggaggcuggcaggggaugguggacggaugguacggcuaucaucacagcaaugaucaaggguccggcuacgccgcugacaaggagagcacacagaaggccuuugacggaaucaccaacaaugucaacucugugauugagaagaugaauacccaguucgaagcgguuggcaaagaguuuuccaaccuggaacgcagacucgagaaucugaacaagaaaauggaagauggguuccuugacguguggacauauaaugccgagcugcucguccugauggagaacgaacggacccuugauuuccacgacagcaaugugaagaaccuguacgauaagguucgcaugcagcucagagacaacgugaaagagcugggaaauggcuguuuugaguucuaucauaagugcgaugacgaguguaugaacucugucaaaaaugggacauacgauuacccuaaguaugaggaagagagcaaacugaaccggaaugaaaucaagggagugaagcucuccucuaugggcgucuaccaaauucuggcuaucuaugccacgguggcugggagccuuucccuggccauuaugauggccggcaucagcuuuuggaugugcucuaacggaucccuccagugcagaaucuguauuuga

SEQ ID NO: 186189 - RNA, 1689 nt, Artificial Sequence
  derived and/or modified sequence opt5 from hemagglutinin__InfluenzaA__ACU79959
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacgaagaaaggauccgacuauccugucgcuaagggcagcuacaacaauaccucuggggagcagaugcugaucauuuggggagugcaccacccgaacgaugagacagaacagcggacccucuaucagaauguuggcacauacguguccgucgggaccagcacgcugaacaagcgcucuacacccgagaucgccaccagaccuaaagugaauggacaaggcggccggauggaauuuuccuggacacugcucgacaugugggauaccauuaacuucgagagcaccgggaaccugaucgcucccgaauacggauuuaagaucucuaaacgcggcuccagcgggauuaugaagacagagggaacgcuugagaauugcgaaaccaaaugucagacaccucugggcgccaucaacaccacacuccccuuccauaaugugcacccgcugaccauuggggagugcccuaaguaugucaaauccgaaaaacuuguucuggcgacgggacucagaaacgugccccagaucgagucucggggccuguuuggcgccauugcuggguucaucgaaggaggcuggcaggggaugguggacggaugguacggcuaucaucacagcaaugaucaaggguccggcuacgccgcugacaaggagagcacacagaaggccuuugacggaaucaccaacaaggucaauucugugauugagaaaaugaacacccaguucgaagcgguuggcaaggaguuuuccaaucuggaacgcagacucgagaaccugaauaaaaagauggaagauggguuccuugacguguggacauauaacgccgagcugcucguccugauggagaaugaacggacccuugauuuccacgacagcaacgugaagaaucuguacgauaaaguucgcaugcagcucagagacaacgugaaggagcugggaaacggcuguuuugaguucuaucauaaaugcgaugacgaguguaugaacucugucaagaaugggacauacgauuacccuaaauaugaggaagagagcaagcugaaucggaacgaaaucaagggagugaaacucuccucuaugggcgucuaccaaauucuggcuaucuaugccacgguggcugggagccuuucccuggccauuaugauggccggcaucagcuuuuggaugugcucuaauggaucccuccagugcagaaucuguauuuga

SEQ ID NO: 186190 - RNA, 1701 nt, Artificial Sequence
  derived and/or modified sequence opt5 from hemagglutinin__InfluenzaA__ACU79970
augaagaccaucauugcccugagcuacauccagugccucguguucgcucaaaaauuucccggcaacgacaauuccacagccacgcugugucuugggcaccaugcggucccuaacggaaccauuguuaagacaaucaccaaugaucagauugaggugacaaacgcuaccgaacuggugcagucuagcuccacaggcgagaucugcgacucuccgcaccagauccucgauggggaaaauuguacccugauugacgcccuucugggagauccccaaugcgacggcuuccagaacaaaaauugggaucucuuugucgagagaagcaaggccuauuccaacuguuacccuuaugacgugcccgauuacgcuucucugcggagccugguugccuccagcgggacgcucgaguucaauaacgaaucuuuuaauuggaccggagugacacagaacggcaccuccagcgcuugcauccgcagaucuaauaacuccuucuuuagcaaacugaauuggcuuacacauucuaaguucaaguauccugcccugaacgucaccaugcccaacaaugagaacuuugacaaacucuacauuuggggcgugcaccauccugggacggauaaugaccagaucuuccuguaugcgcaagccuccggacggauuacaguuagcaccaagcgcucccagcagacagugaucccgaacauuggcucuagaccccggguccgcaauaucccuagcagaaucuccauuuacuggaccaucgugaaacccggggauauucuucugaucaacagcaccggaaaucucauugcuccucggggcuacuuuaagauccgcucugggaaauccagcaucaugagaucugacgcccccauuggaaaguguaacagcgaaugcaucacaccgaauggcuccauuccuaacgacaagcccuuccagaaugugaaccggaucacguauggcgcuuguccucgcuacgucaaacaaaauacccugaagcuggccacagggaugagaaacguucccgagaaacagacccggggaauuuuuggcgcgaucgccggguucaucgaaaauggaugggagggcaugguggaugggugguauggauuccgccaccagaacucugagggcauuggccaagcugccgaccucaagagcacacaggcugccaucgaucagauuaacgggaaacugaauagacuuaucggaaagaccaacgaaaaauuucaccagauugagaaggaguucuccgaaguggaaggccggauccaagaccuggagaaguacgucgaggauacgaaaauugaccucuggagcuauaaugccgaacugcuuguggcucuggagaaccagcauacaaucgaucucaccgacucugaaaugaauaagcuguuugagaaaaccaagaaacagcugagagaaaacgcggaggauauggggaauggaugcuucaagaucuaccacaagugugacaacgccugcauuggcuccauccgcaaugggacauaugaucaugacguuuaccgggacgaggcucucaacaauagauuucagauuaaaggcguggaacuuaagagcggauacaaagauuggauccuguggauuucuuucgccaucuccugcuuucugcucuguaucgcccugcuuggcuucauuaugugggcuugccaaaaggggaacauccgcuguaauauuugcaucuga

SEQ ID NO: 186191 - RNA, 1698 nt, Artificial Sequence
  derived and/or modified sequence opt5 from hemagglutinin__InfluenzaA__ACU79981
augaaggugaaacugcucguccugcuuugcaccuucacagccacguacgcugacaccaucuguauuggcuaucacgccaacaauagcacagauaccguugacacagugcuggagagaaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaggagucuuggagcuacauuguggaaaaaccgaaccccgagaauggcaccuguuauccugggcauuuugccgauuacgaggaacugcgggagcaacucuccucugucagcuccuucgaacgcuuugagaucuuccccaaggagagcucuuggccuaaccacacggugaccggaguuuccgccagcugcucucauaauggcgaauccagcuuuuauagaaaccugcuuuggcugacaggcaagaaugggcucuaccccaaccugucuaaauccuaugcuaauaacaaggagaaagaagugcugguccucuggggagugcaccacccuccgaacaucggcgaccagaaggcccuguaccauaccgagaaugcuuacgugagcgucguuuccucucacuauagccggaaauucacacccgaaauugccaagcgcccuaaggugagagaucaggaggggcggaucaacuacuauuggacccuucugaaacccggagacacgauuaucuuugaggcgaauggcaaccucauugccccucgcuacgcuuucgcccuguccagaggguuuggaagcggcaucauuaauucuaacgcucccauggauaagugugacgccaaaugccagacaccgcaaggcgcgaucaauuccagccuuccuuuccagaacgugcaucccgucaccaucggggaauguccuaaguaugugcggucugccaaacugcgcaugguuacaggacucagaaauauucccagcauccagucccggggccuguuuggggcuauugccggauucaucgagggcggguggaccggaaugguggauggcugguacggcuaucaccaccagaacgaacaagggucuggauacgcugccgaccaaaagagcacccagaaugccauuaacggcaucacaaauaaagucaacuccgugaucgagaagaugaauacgcaguuuaccgcuguugggaaggaguucaacaaacuggaacgcagaauggagaaccucaauaagaaaguggaugacggauucauugauaucuggacauacaacgcggaacugcuuguccugcucgagaaugaacggacccuggacuuucaugacagcaacgugaagaaucuuuaugagaaagucaagucucagcugaagaacaaugccaaagaaauuggcaacgggugcuucgaguuuuaccacaaguguaaugaugagugcauggaauccgugaaaaacggcacauaugacuaccccaaguauagcgaggaaucuaaacucaaucgcgagaagaucgauggaguuaagcuggaguccaugggcguguaccagauucuggcuaucuauagcaccgucgccuccucucucgugcugcuuguuagccugggggccaucuccuucuggaugugcucuaacggaagccuccaguguagaauuugcaucuga

SEQ ID NO: 186192 - RNA, 1698 nt, Artificial Sequence
  derived and/or modified sequence opt5 from hemagglutinin__InfluenzaA__ACU79992
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaagauaaccacaaugggaaacuuugccugcucaagggaaaagcgccccugcagcugggcaacuguucuguugcuggguggauccucggaaauccugagugcggccugcuuauuagcaaggaauccuggucuuacaucguggagagaccgaaccccgaaaaugggaccuguuauccuggacauuuugccgacuacgaggagcugcgggaacaacucagcuccgucucuagcuucgagcgcuuugaaauuuuccccaaggaguccagcuggccuaaccacacggugaccggcguuucugccuccugcagccauaauggcgagucuuccuuuuauaaaaaccugcuuuggcugacagggaagaauggacucuaccccaaccugagcaaaucuuaugcuaauaacaaggaaaaagaggugcugguccucuggggcgugcaccacccuccgaacaucggggaucagaugacccuguaccauaaggaaaaugccuacguguccgucguuagcucccacuauucuagaaaguucacacccgagaucgcuaaacggccuaaggugcgcgaccaggaaggaagaauuaacuacuauuggacccuucuggagcccggcgauacgaucauuuuugaggccaaugggaaccucaucgcgccucgguacgccuucgcucugagccgcggauuuggcuccggcauuaucaauagcaacgcccccauggacgaaugugaugcuaaaugccagacaccgcaaggggccauuaauucuucccuuccuuuccagaacgugcaucccgucaccaucggagaguguccuaaguaugugagaagcgcgaaacugcggaugguuacaggccuccgcaauauccccucuauucagagcagagggcuguuuggagccaucgcuggcuucauugaagggggauggaccggcaugguggacggcugguacggguaucaccaccagaacgagcaaggauccggcuacgccgcugaucagaagucuacccagaaugccaucaacgggauuacaaauaaagucaacagcgugaucgaaaagaugaauacgcaguuuaccgccguuggaaaggaguucaacaaacuggagcggcgcauggaaaaccucaauaagaaaguggacgauggcuucaucgacgucuggacauacaacgcugagcugcuugugcugcucgaaaaugagagaacccuggacuuucaugauuccaacgucaagaaucuuuaugaaaaagugaagaaccaacugaagaauaacgcgaaagagauugggaauggcugcuucgaguuuuaccacaaguguaacgacgaaugcauggagagcguuaaaaauggaacauaugauuaccccaaguauucugaagaguccaaacucagccgggagaagaucgacggcgugaagcuggaaucuaugggggucuaccagauucuggccaucuauuccaccguggcuagcucccucguucugcuugugucucugggagccauuagcuucuggaugugcuccaacggcucucuccagugucgcaucugcaucuga

SEQ ID NO: 186193 - RNA, 1701 nt, Artificial Sequence; identical to SEQ ID NO: 185458
  derived and/or modified sequence opt5 from hemagglutinin__InfluenzaA__ACU80003

SEQ ID NO: 186194 - RNA, 1698 nt, Artificial Sequence
  derived and/or modified sequence opt5 from hemagglutinin__InfluenzaA__ACU80025
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuaucgcaaccugcuuuggcugaccggcaaaaaugggcucuaccccaaccugucuaaguccuaugccaauaacaaagagaaggaagugcugguccucuggggagugcaccacccuccgaacaucggcgaccagaaagcucuguaccauacagagaaugccuacgugagcgucguuuccucucacuauagcagaaaguucacccccgaaauugcgaagcggccuaaagugcgcgaucaggaggggagaaucaacuacuauuggacacuucuggagcccggagacaccauuaucuuugaagccaauggcaaccucauugcuccucgguacgccuucgcucugucccgcggguuuggaagcggcaucauuaauucuaacgcccccauggauaagugugacgcgaaaugccagacgccgcaaggcgccaucaauuccagccuuccuuuccagaacgugcaucccgucacaaucggggaguguccuaaguaugugagaucugcuaaacugcggaugguuaccggacuccgcaauauucccagcauccaguccagaggccuguuuggggccauugcuggauucaucgaaggcggguggacaggaaugguggauggcugguacggcuaucaccaccagaacgagcaagggucuggauacgccgccgaccaaaagagcacccagaaugcuauuaacggcaucaccaauaaagucaacuccgugaucgaaaagaugaauacacaguuuacggcgguugggaaggaguucaacaaacuggagcggcgcauggaaaaccucaauaagaaaguggaugacggauucauugauaucuggaccuacaacgccgagcugcuuguccugcucgaaaaugagagaacacuggacuuucaugacagcaacgugaagaaucuuuaugaaaaagucaagucucagcugaagaacaaugcuaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccaugggcguguaccagauucuggccaucuauagcacagucgccuccucucucgugcugcuuguuagccugggggcuaucuccuucuggaugugcucuaacggaagccuccagugucgcauuugcaucuga

SEQ ID NO: 186195 - RNA, 1701 nt, Artificial Sequence
  derived and/or modified sequence opt5 from hemagglutinin__InfluenzaA__ACU80036
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguucuagcgaaugcaucacaccgaacggcuccauuccuaaugacaagcccuuucagaacgugaaucgcaucacguauggcgcuuguccuagauacgucaaacaaaacacccugaagcuggccacagggaugcggaauguucccgagaaacagacccgcggaauuuucggcgcgaucgccggguuuaucgaaaacggaugggagggcaugguggaugggugguauggauucagacaccaaaauucugagggccggggccaggcugccgaccuuaagagcacacaggcugccauugaucagaucaacgggaaacucaauagacugauuggaaagaccaacgaaaaauuccaccagaucgagaaggaauuuuccgagguggaaggccgcauucaagaccuugagaaguacgucgaggauacgaaaaucgaccuguggagcuauaacgccgaacuccugguggcucuggagaaucagcauacaauugaucucaccgacucugaaaugaacaagcuguucgagaaaaccaagaaacagcuucgggaaaaugcggaggauaucgggaacggaugcuuuaagaucuaccacaagugugacaaugccugcauuggcuccaucagaaacgggacauaugaucaugacguuuaccgcgacgaggcucugaauaaccgguuccagauuaaaggcguggaacucaagagcggauacaaagauuggauccuguggauuucuuuugccaucuccugcuuccuucugugugucgcccuccugggcuuuaucaugugggcuugccaaaaggggaauauuagauguaacaucugcauuuga

SEQ ID NO: 186196 - RNA, 1698 nt, Artificial Sequence; identical to SEQ ID NO: 185667
  derived and/or modified sequence opt5 from hemagglutinin__InfluenzaA__ACU80047

SEQ ID NO: 186197 - RNA, 1701 nt, Artificial Sequence
  derived and/or modified sequence opt5 from hemagglutinin__InfluenzaA__ACU80058
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgggaucugcgacucuccgcaccagauccuugauggagagaauuguacccugauugacgcccuccugggcgauccccagugcgacggguuucaaaacaaaaagugggaucuguucgucgaaagaagcaaagccuguuccaauugcuauccuuacgacgugcccgauuaugcuucucuccggagccugguugccuccagcggaacgcuugaguuuaacaaugaaucuuucaacuggaccggcgugacacagaauggcaccuccagcgcuuguaagcgcagaucuaacaauuccuuuuucagccggcugaacuggcucacacaucugaaguuuaaauacccugcccuuaaugucaccaugcccaacaacgagaaguucgacaaacuguauaucuggggagugcaccauccugggacggauaaugaccagauuuuucucuacgcgcaggccucuggccgcaucacaguuuccaccaagagaagccaacagacagugauuccgaacaucgggucccggccccgcgucagaaauauuccuucucggaucagcaucuauuggaccauugugaaacccggagauauccugcugauuaacuccaccggcaaucucaucgcuccucgcggguacuucaagauuagaagcggaaagucuuccaucaugcggagcgacgcccccaucggcaaaugcaacucugaguguauuacaccgaauggcagcaucccuaacgacaagcccuuucagaaugugaaccgcauuacguacggggcuugcccuagauaugucaaacagaauacccugaaacuugccacaggaaugcggaacguucccgaaaagcaaacccgcggcaucuucggggcgauugccggauuuaucgagaauggcugggaagggaugguggauggaugguacggcuucagacaccagaacuccgagggcaucgggcaggcugccgaccugaagucuacacaagcugccauuaaucagaucaacggaaaacucaaccggcugauuggcaagaccaaugagaaguuccaccagaucgaaaaagaguuuagcgaaguggaggggcgcauucaggaucuugaaaaguaugucgaggacacgaaaaucgaucugugguccuacaacgccgagcuccugguggcucuggaaaaucaacauacaauugaccucaccgauagcgagaugaacaagcuguucgaaagaaccaaaaagcagcuucgggagaaugcggaagacaugggaaacggcuguuuuaagaucuaucacaaaugcgauaaugccugcaucgggucuauuagaaacggcacauacgaccaugauguuuaucgcgacgaggcucugaauaaccgguuccagaucaagggaguggagcucaaauccggcuacaaggacuggauucuguggaucagcuuugccauuucuuguuuccuucugugcgucgcccuccugggguuuaucaugugggcuugucagaaaggaaauaucagaugcaacauuuguaucuga

SEQ ID NO: 186198 - RNA, 1698 nt, Artificial Sequence; identical to SEQ ID NO: 185512
  derived and/or modified sequence opt5 from hemagglutinin__InfluenzaA__ACU80069

SEQ ID NO: 186199 - RNA, 1698 nt, Artificial Sequence
  derived and/or modified sequence opt5 from hemagglutinin__InfluenzaA__ACU80080
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucguggaccagaaaacccuguacagaacagagaaugccuacgucagcguuguguccucucauuauagccggaaguucacccccgaaauugcuaagcgcccuaaagugagagaucaggagggccggaucaacuacuauuggacgcuucuggagcccggggacacaauuaucuuugaagccaauggaaaccucauugcgccucgcuacgccuucgcucuguccagaggcuuugggagcggaaucauuaauucuaacgcccccauggauaagugugacgcuaaaugccagaccccgcaaggcgccaucaauuccagccuuccuuuccagaacguccaccccgugacaaucggcgaguguccuaaguauguucggucugcgaaacugcgcauggugaccgggcucagaaauauucccagcauccagucccggggacuguuuggcgccauugcuggguucaucgaaggaggcuggaccgggauggucgauggaugguacggcuaucaucaccagaacgagcaaggcucuggguacgccgcugaccaaaagagcacacagaaugccauuaacggaaucacgaauaaagugaacuccguuaucgaaaagaugaauacccaguuuacagccgugggcaaggaguucaacaaacuggagcgcagaauggaaaaccucaauaagaaagucgaugacggguucauugauaucuggaccuacaacgcugagcugcuugugcugcucgaaaaugagcggacacuggacuuucacgacagcaacgucaagaaucuuuaugaaaaagugaagucucagcugaagaacaaugcgaaagagauuggaaacggcugcuucgaguuuuaccauaaguguaaugaugaaugcauggaguccguuaaaaacgggaccuaugacuaccccaaguauagcgaagagucuaaacucaaucgcgagaagaucgauggcauuaagcuggaauccaugggaguguaccagauccuggccaucuauagcacggucgcuuccucucucgugcugcuuguuagccugggcgccauuuccuucuggaugugcucuaacgggagccuccaguguagaaucugcauuuga

SEQ ID NO: 186200 - RNA, 1698 nt, Artificial Sequence; identical to SEQ ID NO: 185798
  derived and/or modified sequence opt5 from hemagglutinin__InfluenzaA__ACU80091

SEQ ID NO: 186201 - RNA, 1701 nt, Artificial Sequence; identical to SEQ ID NO: 185561
  derived and/or modified sequence opt5 from hemagglutinin__InfluenzaA__ACU80102

SEQ ID NO: 186202 - RNA, 1701 nt, Artificial Sequence
  derived and/or modified sequence opt5 from hemagglutinin__InfluenzaA__ACU80113
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacagcgaaugcaucacaccgaauggcuccauuccuaacgacaagcccuuccagaaugugaaccgcaucacguauggcgcuuguccuagauacgucaagcagaauacccugaaacucgccacagggaugcggaacguucccgagaagcaaacccgcggaauuuuuggcgcgaucgccggguucaucgaaaauggaugggagggcaugguggaugggugguauggauucagacaccagaacucugagggcauuggccaggcugccgaccugaaaagcacacaagcugccaucgaucagauuaacgggaaacuuaaucggcugaucggaaagaccaacgaaaaguuucaccagauugagaaagaguucuccgaaaucgaaggccgcauucaggaccucgagaaguacguggaggauacgaagaucgaccuguggagcuauaaugccgaacuucuggucgcucucgagaaccaacauacaaucgaucugaccgacucugaaaugaauaaacuguuugagaagaccaaaaagcagcucagagaaaacgcggaggauauggggaauggaugcuucaaaauuuaccacaagugugacaacgccugcaucggcuccauucggaaugggacauaugaucaugacguguacagagacgaggcucugaacaaucgcuuucagaucaagggcguugaacuuaaaagcggauacaagaacuggauucuguggaucucuuucgccaucuccugcuuucuccuguguauugcccuucugggcuucaucaugugggcuugccagaaagggaauauucgguguaacaucugcauuuga

SEQ ID NO: 186203 - RNA, 1701 nt, Artificial Sequence
  derived and/or modified sequence opt5 from hemagglutinin__InfluenzaA__ACU80135
augaagaccaucauugcccugagcuacauccucugccugguguucgcucagaaauuucccggcaacgacaauuccacagccacgcuuugucuggggcaccaugcggucccuaacggaaccaugguuaagacaauuaccaaugaucaaaucgaggugacaaacgcuaccgaacucgugcagucuagcuccacaggcgagauuugcgacucuccgcaccagauccuggauggggaaaauuguacccuuaucgacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauucgcagaucuaauaacuccuucuuuagccggcuuaauuggcugacacauucuaaauucaaguauccugcccucaacgucaccaugcccaacaaugagaacuuugacaagcuguacaucuggggcgugcaccauccugggacggauaaugaccagauuuuccuuuaugcgcaggccuccggacgcaucacaguuagcaccaaaagaucccaacagacagugauuccgaacaucggcucucggccccgcgucagaaauauuccuagccggaucuccaucuacuggaccauugugaagcccggggauauccugcucauuaacagcaccggaaaucugaucgcuccucgcggcuacuuuaaaauuagaucugggaaguccagcaucaugcggucugacgcccccaucggaaaauguaacagcgaaugcauuacaccgaauggcuccaucccuaacgacaagcccuuccagaaugugaaccgcauuacguauggcgcuuguccuagauacgucaagcagaauacccugaaacucgccacagggaugcggaacguucccgagaagcaaacccgcggaaucuuuggcgcgauugccggguucaucgaaaauggaugggagggcaugguggaugggugguauggauucagacaccagaacucugagggcaucggccaggcugccgaccugaaaagcacacaagcugccauugaucagaucaacgggaaacuuaaucggcugauuggaaagaccaacgaaaaguuucaccagaucgagaaagaguucuccgaaguggaaggccgcauucaggaccucgagaaguacgucgaggauacgaagaucgaccuguggagcuauaaugccgaacuucugguggcucucgagaaccaacauacaauugaucugaccgacucugaaaugaauaaacuguuugagaagaccaaaaagcagcucagagaaaacgcggaggauauggggaauggaugcuucaaaaucuaccacaagugugacaacgccugcaucggcuccauucggaaugggacauaugaucaugacguuuacagagacgaggcucugaacaaucgcuuucagaucaagggcguggaacuuaaaagcggauacaaggauuggauucuguggaucucuuucgccauuuccugcuuucuccuguguaucgcccuucugggcuucaucaugugggcuugccagaaagggaacauucgguguaauaucugcauuuga

SEQ ID NO: 186204 - RNA, 1701 nt, Artificial Sequence
  derived and/or modified sequence opt5 from hemagglutinin__InfluenzaA__ACU80146
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgcgagaacgcggaggauauggggaauggaugcuuuaagaucuaccacaagugugacaacgccugcauuggcuccauccggaaugggacauaugaucaugacguuuacagagacgaagcucuuaacaaucgcuuccagauuaaaggcguggagcucaagagcggauacaaagauuggauccuguggauuucuuuugccaucuccugcuuccugcuuugugucgcccugcucggccugaucaugugggcuugccagaaggggaacauucgguguaauaucugcauuuga

SEQ ID NO: 186205 - RNA, 1701 nt, Artificial Sequence; identical to SEQ ID NO: 185458
  derived and/or modified sequence opt5 from hemagglutinin__InfluenzaA__ACU80157

SEQ ID NO: 186206 - RNA, 1698 nt, Artificial Sequence; identical to SEQ ID NO: 186194
  derived and/or modified sequence opt5 from hemagglutinin__InfluenzaA__ACU80168

SEQ ID NO: 186207 - RNA, 1701 nt, Artificial Sequence; identical to SEQ ID NO: 185458
  derived and/or modified sequence opt5 from hemagglutinin__InfluenzaA__ACU80179

SEQ ID NO: 186208 - RNA, 1701 nt, Artificial Sequence
  derived and/or modified sequence opt5 from hemagglutinin__InfluenzaA__ACU80190
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgcgagaacgcggaggauauggggaauggaugcuuuaagaucuaccacaagugugacaacgccugcauuggcuccauccggaaugggacauaugaucaugacguuuacagagacgaagcucuuaacaaucgcuuccagauuaaaggcaucgagcucaagagcggauacaaagauuggauucuguggaucucuuuugccaucuccugcuuccugcuuuguguggcccugcucggcuuuauuaugugggcuugccagaaggggaacauccgguguaauauuugcaucuga

SEQ ID NO: 186209 - RNA, 1701 nt, Artificial Sequence
  derived and/or modified sequence opt5 from hemagglutinin__InfluenzaA__ACU80201
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccagaucaaaggcguggaacucaaguccggauacaaagauuggauucuguggaucagcuuugccauuucuugcuuccuucugugugucgcccuccugggcuuuaucaugugggcuugccaaaaggggaacaucaaauguaauauuugcaucuga

SEQ ID NO: 186210 - RNA, 1701 nt, Artificial Sequence; identical to SEQ ID NO: 185458
  derived and/or modified sequence opt5 from hemagglutinin__InfluenzaA__ACU80212

SEQ ID NO: 186211 - RNA, 1698 nt, Artificial Sequence
  derived and/or modified sequence opt5 from hemagglutinin__InfluenzaA__ACU80234
augaaggugaaacugcucguccugcuuugcaccuucgccgcuacauacgccgacacgaucuguauuggcuaucacgcgaacaauagcaccgauacaguugacaccgugcuggagaagaacgugacagucacccauuccgugaaucuccuggaaaacucucacaaugggaaacuuugccugcucaagggaaucgcuccccugcagcugggcaacuguagcguugccggguggauucucggaaauccugagugcgaacugcuuaucuccaaagagucuuggagcuacauuguggaaaagccgaaccccgagaauggcacauguuauccugggcauuuugccgauuacgaggaacugagagagcaacucuccucugucagcuccuucgaacgguuugagaucuuccccaaggagagcucuuggccuaaccacaccgugacgggaguuuccgcuagcugcucucauaauggcgaauccagcuuuuauaaaaaccugcuuuggcugaccggcaagaaugggcucuaccccaaccugucuaaauccuaugccaauaacaaggagaaagaagugcugguccucuggggagugcaccacccuccgaacaucggcgaccagaaggcucuguaccauacagagaaugccuacgugagcgucguuuccucucacuauagccgcaaguucacccccgaaauugcgaaaagaccuaaggugcgggaucaggaggggcgcaucaacuacuauuggacacuucuggagcccggagacaccauuaucuuugaagccaauggcaaccucauugcuccuagauacgccuucgcucugucccggggguuuggaagcggcaucauuaauucuaacgcccccauggauaaaugugacgcgaagugccagacgccgcaaggcgccaucaauuccagccuuccuuuccagaacgugcaucccgucacaaucggggaguguccuaaauaugugcgcucugcuaagcugagaaugguuaccggacuccggaauauucccagcauccagucccgcggccuguuuggggccauugcuggauucaucgaaggcggguggacaggaaugguggauggcugguacggcuaucaccaccagaacgagcaagggucuggauacgccgccgaccagaaaagcacccagaaugcuauuaacggcaucaccaauaaggucaacuccgugaucgaaaagaugaauacacaguuuacggcgguugggaaagaguucaacaagcuggagagacggauggaaaaccucaauaaaaagguggaugacggauucauugauaucuggaccuacaacgccgagcugcuuguccugcucgaaaaugagcgcacacuggacuuucaugacagcaacgugaaaaaucuuuaugaaaaggucaagucucaacugaaaaacaaugcuaaggagauuggcaacgggugcuucgaguuuuaccacaaauguaaugaugaaugcauggaguccgugaagaacggcaccuaugacuaccccaaauauagcgaagagucuaagcucaauagagagaagaucgauggaguuaaacuggaauccaugggcguguaccagauucuggccaucuauagcacagucgccuccucucucgugcugcuuguuagccugggggcuaucuccuucuggaugugcucuaacggaagccuccagugucggauuugcaucuga

SEQ ID NO: 186212 - RNA, 1701 nt, Artificial Sequence
  derived and/or modified sequence opt5 from hemagglutinin__InfluenzaA__ACU80245
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggacgcuguaacagcgaaugcaucacaccgaauggcuccauuccuaacgacaaacccuuccagaaugugaacagaaucacguauggcgcuuguccucgguacgucaagcagaauacccugaagcucgccacagggaugcgcaacguucccgagaaacaaaccagaggaauuuuuggcgcgaucgccggguucaucgaaaauggaugggagggcaugguggaugggugguauggauuccggcaccagaacucugagggcauuggccaggcugccgaccuuaagagcacacaagcugccaucgaucagauuaacgggaaacugaauagacugaucggaaagaccaacgaaaaauuucaccagauugagaaggaguucuccgaaguggaaggccgcauccaggaccucgagaaauacgucgaggauacgaagauugaccuguggagcuauaaugccgaacuucugguggcucucgagaaccaacauacaaucgaucugaccgacucugaaaugaauaagcuguuugagaaaaccaagaaacagcuccgggaaaacgcggaggauauggggaauggaugcuucaagaucuaccacaaaugugacaacgccugcauuggcuccaucagaaaugggacauaugaucaugacguuuaccgcgacgaggcucugaacaaucgguuucagauuaagggcguggaacuuaagagcggauacaaagauuggauccuguggauuucuuucgccaucuccugcuuucuccuguguaucgcccuucugggcuucauuaugugggcuugccagaaggggaacaucagauguaauauuugcaucuga

SEQ ID NO: 186213 - RNA, 1701 nt, Artificial Sequence; identical to SEQ ID NO: 185561
  derived and/or modified sequence opt5 from hemagglutinin__InfluenzaA__ACU80256

SEQ ID NO: 186214 - RNA, 1698 nt, Artificial Sequence; identical to SEQ ID NO: 185512
  derived and/or modified sequence opt5 from hemagglutinin__InfluenzaA__ACU80267

SEQ ID NO: 186215 - RNA, 1698 nt, Artificial Sequence; identical to SEQ ID NO: 186194
  derived and/or modified sequence opt5 from hemagglutinin__InfluenzaA__ACU80278

SEQ ID NO: 186216 - RNA, 1701 nt, Artificial Sequence; identical to SEQ ID NO: 185458
  derived and/or modified sequence opt5 from hemagglutinin__InfluenzaA__ACU80289

SEQ ID NO: 186217 - RNA, 1701 nt, Artificial Sequence; identical to SEQ ID NO: 185561
  derived and/or modified sequence opt5 from hemagglutinin__InfluenzaA__ACU80300

SEQ ID NO: 186218 - RNA, 1701 nt, Artificial Sequence
  derived and/or modified sequence opt5 from hemagglutinin__InfluenzaA__ACU80311
augagaaccaucauugcccugagcuacauccucugccugguguucgcucagaaguuucccggcaacgacaauuccacagccacgcuuugucuggggcaccaugcggucccuaacggaaccauuguuaaaacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaagaauugggaucuguuugucgagcggagcaaagccuauuccaacuguuacccuuaugacgugcccgauuacgcuucucugcgcagccucguugccuccagcgggacgcuggaguucaauaacgaaucuuuuaauuggaccggagugacacagaacggcaccuccagcgcuugcaucagacggucuaauaacuccuucuuuagccgccuuaauuggcugacacauucuaaguucaaauauccugcccucaacgucaccaugcccaacaaugagaacuuugacaagcuguacauuuggggcgugcaccauccugggacggauaaugaccagaucuuccuuuaugcgcaggccuccggaagaauuacaguuagcaccaagcggucccaacagacagugaucccgaacauuggcucucgccccagaguccggaauaucccuagccgcaucuccauuuacuggaccaucgugaaacccggggauauucugcucaucaacagcaccggaaaucugauugcuccuagaggcuacuuuaagauccggucugggaaauccagcaucaugcgcucugacgcccccauuggaaaguguaacagcgaaugcaucacaccgaauggcuccauuccuaacgacaaacccuuccagaaugugaacagaaucacguauggcgcuuguccucgguacgucaagcagaauacccugaagcucgccacagggaugcgcaacguucccgagaaacaaaccagaggaauuuuuggcgcgaucgccggguucaucgaaaauggaugggagggcaugguggaugggugguauggauuccggcaccagaacucugagggcauuggccaggcugccgaccuuaagagcacacaagcugccaucgaucagauuaacgggaaacugaauagacugaucggaaagaccaacgaaaaauuucaccagauugagaaggaguucuccgaaguggaaggccgcauccaggaccucgagaaauacgucgaggauacgaagauugaccuguggagcuauaaugccgaacuucugguggcucucgagaaccaacauacaaucgaucugaccgacucugaaaugaauaagcuguuugagaaaaccaagaaacagcuccgggaaaacgcggaggauauggggaauggaugcuucaagaucuaccacaaaugugacaacgccugcauuggcuccaucagaaaugggacauaugaucaugacguuuaccgcgacgaggcucugaacaaucgguuucagauuaagggcguggaacuuaagagcggauacaaagauuggauccuguggauuucuuucgccaucuccugcuuucuccuguguaucgcccuucugggcuucauuaugugggcuugccagaaggggaacaucagauguaauauuugcaucuga

SEQ ID NO: 186219 - RNA, 1701 nt, Artificial Sequence; identical to SEQ ID NO: 185561
  derived and/or modified sequence opt5 from hemagglutinin__InfluenzaA__ACU80322

SEQ ID NO: 186220 - RNA, 1701 nt, Artificial Sequence; identical to SEQ ID NO: 185458
  derived and/or modified sequence opt5 from hemagglutinin__InfluenzaA__ACU80333

SEQ ID NO: 186221 - RNA, 1701 nt, Artificial Sequence; identical to SEQ ID NO: 185561
  derived and/or modified sequence opt5 from hemagglutinin__InfluenzaA__ACU80344

SEQ ID NO: 186222 - RNA, 1701 nt, Artificial Sequence; identical to SEQ ID NO: 185561
  derived and/or modified sequence opt5 from hemagglutinin__InfluenzaA__ACU80355

SEQ ID NO: 186223 - RNA, 1701 nt, Artificial Sequence; identical to SEQ ID NO: 185561
  derived and/or modified sequence opt5 from hemagglutinin__InfluenzaA__ACU80366

SEQ ID NO: 186224 - RNA, 1701 nt, Artificial Sequence
  derived and/or modified sequence opt5 from hemagglutinin__InfluenzaA__ACU80377
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacuucgaaugcaucacaccgaauggcagcauuccuaacgacaagcccuuucagaaugugaaccgcaucacguauggcgcuuguccuagauacgucaagcagaauacccugaaacucgccacagggaugcggaacguucccgagaagcaaacccgcggaauuuucggcgcgaucgccggguucaucgaaaauggaugggagggcaugguggaugggugguauggauuuagacaccagaacuccgagggcauuggccaggcugccgaccugaaaucuacacaagcugccaucgaucagauuaacgggaaacuuaaucggcugaucggaaagaccaacgaaaaguuccaccagauugagaaagaauuuagcgagguggaaggcagaauccaggaccucgagaaguacgucgaggauacgaagauugaccugugguccuauaaugccgaacuucugguggcucucgagaaccaacauacaaucgaucugaccgacagcgaaaugaauaaacuguucgagaagacccgcaaacagcuccgggaaaacgcggaggauauggggaauggaugcuuuaagaucuaccacaaaugugacaacgccugcauuggcucuaucagaaaugggacauaugaucaugacguuuaccgcgacgaggcucugaacaaucgguuccagauuaagggcguggaacuuaaguccggauacaaagauuggauccuguggauuagcuuugccaugucuugcuuccuccuguguaucgcccuucugggcuuuaucaugugggcuugccagaaggggaacauuagauguaauaucugcauuuga

SEQ ID NO: 186225 - RNA, 1701 nt, Artificial Sequence; identical to SEQ ID NO: 185561
  derived and/or modified sequence opt5 from hemagglutinin__InfluenzaA__ACU80388

SEQ ID NO: 186226 - RNA, 1701 nt, Artificial Sequence; identical to SEQ ID NO: 185458
  derived and/or modified sequence opt5 from hemagglutinin__InfluenzaA__ACU80399

SEQ ID NO: 186227 - RNA, 1698 nt, Artificial Sequence
  derived and/or modified sequence opt5 from hemagglutinin__InfluenzaA__ACU80410
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaagcccuguaccauaccgagaaugcuuacgugagcgucguuuccucucacuauagcagaaaguucacacccgaaauugccaagcggccuaaagugcgcgaucaggaggggagaaucaacuacuauuggacccuucuggagcccggagacacgauuaucuuugaagcgaauggcaaccucauugccccucgguacgcuuucgcccugucccgcggguuuggaagcggcaucauuaauucuaacgcucccauggauaagugugacgccaaaugccagacaccgcaaggcgcgaucaauuccagccuuccuuuccagaacgugcaucccgucaccaucggggaguguccuaaguaugugagaucugccaaacugcggaugguuacaggacuccgcaauauucccagcauccaguccagaggccuguuuggggcuauugccggauucaucgaaggcggguggaccggaaugguggauggcugguacggcuaucaccaccagaacgagcaagggucuggauacgcugccgaccaaaagagcacccagaaugccauuaacggcaucacaaauaaagucaacuccgugaucgaaaagaugaauacgcaguuuaccgcuguugggaaggaguucaacaaacuggagcggcgcauggaaaaccucaauaagaaaguggaugacggauucauugauaucuggacauacaacgcggagcugcuuguccugcucgaaaaugagagaacccuggacuuucaugacagcaacgugaagaaucuuuaugaaaaagucaagaaccagcugaagaauaacgccaaagagauuggcaaugggugcuucgaguuuuaccacaaguguaacgaugaaugcauggagucugugaaaaauggcacauaugacuaccccaaguauuccgaagagagcaaacucaaccgggagaagaucgauggaguuaagcuggaaucuaugggcguguaccagauucuggcuaucuauuccaccgucgccagcucccucgugcugcuuguuucucugggggccaucagcuucuggaugugcuccaauggaucucuccagugucgcauuugcaucuga

SEQ ID NO: 186228 - RNA, 1701 nt, Artificial Sequence
  derived and/or modified sequence opt5 from hemagglutinin__InfluenzaA__ACU80424
augaagaccaucauugcccugagcuacauccucugccugguguucgcucagaaauuucccggcaacgacaauuccacagccacgcuuugucuggggcaccaugcggucccuaacggaaccauuguuaagacaaucaccaaugaucaaauugaggugacaaacgcuaccgaacucgugcagucuagcuccacaggcgagaucugcgacucuccgcaccagauccuggauggggaaaauuguacccuuauugacgcccugcucggagauccccagugcgacggcuuccaaaacaaaaauugggaucuguuugucgagagaagcaaggccuauuccaacuguuacccuuaugacgugcccgauuacgcuucucugcggagccucguugccuccagcgggacgcuggaguucaauaacgaaucuuuuaauuggaccggagugacacagaacggcaccuccagcgcuugcauccgcagaucuaauaacuccuucuuuagccggcuuaauuggcugacacauucuaaauucaaguauccugcccucaacgucaccaugcccaacaaugagaacuuugacaagcuguacauuuggggcgugcaccauccugggacggauaaugaccagaucuuccuuuaugcgcaggccuccggacgcauuacaguuagcaccaaaagaucccaacagacagugaucccgaacauuggcucucggccccgcgucagaaauaucccuagccggaucuccauuuacuggaccaucgugaagcccggggauauucugcucaucaacagcaccggaaaucugauugcuccucgcggcuacuuuaaaaucagaucugggaaguccagcaucaugcggucugacgcccccauuggaaaauguaacuucgaaugcaucacaccgaauggcagcauuccuaacgacaagcccuuucagaaugugaaccgcaucacguauggcgcuuguccuagauacgucaagcagaauacccugaaacucgccacagggaugcggaacguucccgagaagcaaacccgcggaauuuucggcgcgaucgccggguucaucgaaaauggaugggagggcaugguggaugggugguauggauuuagacaccagaacuccgagggcauuggccaggcugccgaccugaaaucuacacaagcugccaucgaucagauuaacgggaaacuuaaucggcugaucggaaagaccaacgaaaaguuccaccagauugagaaagaauuuagcgagguggaaggcagaauccaggaccucgagaaguacgucgaggauacgaagauugaccugugguccuauaaugccgaacuucugguggcucucgagaaccaacauacaaucgaucugaccgacagcgaaaugaauaaacuguucgagaagacccgcaaacagcuccgggaaaacgcggaggauauggggaauggaugcuuuaagaucuaccacaaaugugacaacgccugcauuggcucuaucagaaaugggacauaugaucaugacguuuaccgcgacgaggcucugaacaaucgguuccagauuaagggcguggaacuuaaguccggauacaaagauuggauccuguggauuagcuuugccaucucuugcuuccuccuguguaucgcccuucugggcuuuauuaugugggcuugccagaaggggaacaucagauguaauauuugcaucuga

SEQ ID NO: 186229 - RNA, 1701 nt, Artificial Sequence; identical to SEQ ID NO: 186228
  derived and/or modified sequence opt5 from hemagglutinin__InfluenzaA__ACU80435

SEQ ID NO: 186230 - RNA, 1698 nt, Artificial Sequence
  derived and/or modified sequence opt5 from hemagglutinin__InfluenzaA__ACU80446
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacucucacaaugggaaacuuugccugcucaagggaaucgcgccccugcagcugggcaacuguagcguugcuggguggauucucggaaauccugagugcgaacugcuuaucuccaaagagucuuggagcuacauuguggaaaagccgaaccccgagaauggcaccuguuauccugggcauuuugccgauuacgaggaacugagagagcaacucuccucugucagcuccuucgaacgguuugagaucuuccccaaggagagcucuuggccuaaccacacggugaccggaguuuccgccagcugcucucauaauggcgaauccagcuuuuaucgcaaccugcuuuggcugacaggcaaaaaugggcucuaccccaaccugucuaaguccuaugcuaauaacaaagagaaggaagugcugguccucuggggagugcaccacccuccgaacaucggcgaccagaaaacccuguaccauacagagaaugccuacgugagcgucguuuccucucacuauagcagaaaguucacccccgaaauugcuaagcggccuaaagugcgcgaucaggaggggagaaucaacuacuauuggacgcuucuggagcccggagacacaauuaucuuugaagccaauggcaaccucauugcgccucgguacgccuucgcucugucccgcggguuuggaagcggcaucauuaauucuaacgcccccauggauaagugugacgcuaaaugccagaccccgcaaggcgccaucaauuccagccuuccuuuccagaacgugcaucccgucacaaucggggaguguccuaaguaugugagaucugcgaaacugcggaugguuaccggacuccgcaauauucccagcauccaguccagaggccuguuuggggccauugcuggauucaucgaaggcggguggaccggaaugguggauggcugguacggcuaucaccaccagaacgagcaagggucuggauacgccgcugaccaaaagagcacacagaaugccauuaacggcaucacgaauaaagucaacuccgugaucgaaaagaugaauacccaguuuacagccguugggaaggaguucaacaaacuggagcggcgcauggaaaaccucaauaagaaaguggaugacggauucauugauaucuggaccuacaacgcugagcugcuuguccugcucgaaaaugagagaacacuggacuuucaugacagcaacgugaagaaucuuuaugaaaaagucaagucucagcugaagaacaaugcgaaagagauuggcaacgggugcuucgaguuuuaccacaaguguaaugaugaaugcauggaguccgugaaaaacggcaccuaugacuaccccaaguauagcgaagagucuaaacucaaucgggagaagaucgauggaguuaagcuggaauccauggagguguaccagauucuggccaucuauagcacggucgcuuccucucucgugcugcuuguuagccugggcgccaucuccuucuggaugugcucuaacgggagccuccagugucgcauuugcaucuga

SEQ ID NO: 186231 - RNA, 1701 nt, Artificial Sequence; identical to SEQ ID NO: 185458
  derived and/or modified sequence opt5 from hemagglutinin__InfluenzaA__ACU80458

SEQ ID NO: 186232 - RNA, 1701 nt, Artificial Sequence; identical to SEQ ID NO: 185458
  derived and/or modified sequence opt5 from hemagglutinin__InfluenzaA__ACU80470

SEQ ID NO: 186233 - RNA, 1701 nt, Artificial Sequence; identical to SEQ ID NO: 185561
  derived and/or modified sequence opt5 from hemagglutinin__InfluenzaA__ACU80600

SEQ ID NO: 186234 - RNA, 1701 nt, Artificial Sequence; identical to SEQ ID NO: 186228
  derived and/or modified sequence opt5 from hemagglutinin__InfluenzaA__ACU80611

SEQ ID NO: 186235 - RNA, 1701 nt, Artificial Sequence; identical to SEQ ID NO: 185561
  derived and/or modified sequence opt5 from hemagglutinin__InfluenzaA__ACU80622

SEQ ID NO: 186236 - RNA, 1701 nt, Artificial Sequence; identical to SEQ ID NO: 185458
  derived and/or modified sequence opt5 from hemagglutinin__InfluenzaA__ACU80633

SEQ ID NO: 186237 - RNA, 1701 nt, Artificial Sequence
  derived and/or modified sequence opt5 from hemagglutinin__InfluenzaA__ACU80644
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgcgagaacgcggaggauauggggaauggaugcuuuaagaucuaccacaagugugacaacgccugcauuggcuccauccggaaugggacauaugaucaugacguuuacagagacgaagcucuuaacaaucgcuuccagauuaaaggcguggagcucaagagcggauacaaagauuggauccuguggauuucuuuugccaucuccugcuuccugcuuugugucgcccugcucggcuuuaucaugugggcuugccagaaggggaacauucgguguaauaucugcauuuga

SEQ ID NO: 186238 - RNA, 1701 nt, Artificial Sequence; identical to SEQ ID NO: 185458
  derived and/or modified sequence opt5 from hemagglutinin__InfluenzaA__ACU80655

SEQ ID NO: 186239 - RNA, 1701 nt, Artificial Sequence; identical to SEQ ID NO: 185458
  derived and/or modified sequence opt5 from hemagglutinin__InfluenzaA__ACU80666

SEQ ID NO: 186240 - RNA, 1701 nt, Artificial Sequence; identical to SEQ ID NO: 184952
  derived and/or modified sequence opt5 from hemagglutinin__InfluenzaA__ACU80677

SEQ ID NO: 186241 - RNA, 1701 nt, Artificial Sequence; identical to SEQ ID NO: 185458
  derived and/or modified sequence opt5 from hemagglutinin__InfluenzaA__ACU80688

SEQ ID NO: 186242 - RNA, 1701 nt, Artificial Sequence; identical to SEQ ID NO: 185561
  derived and/or modified sequence opt5 from hemagglutinin__InfluenzaA__ACU80699

SEQ ID NO: 186243 - RNA, 1701 nt, Artificial Sequence; identical to SEQ ID NO: 185561
  derived and/or modified sequence opt5 from hemagglutinin__InfluenzaA__ACU80710

SEQ ID NO: 186244 - RNA, 1701 nt, Artificial Sequence
  derived and/or modified sequence opt5 from hemagglutinin__InfluenzaA__ACU80721
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaacagaggugaccaacgcuacagaacuggugcagucuagcuccaccggcgagauuugcgacucuccgcaccagauccuugauggggaaaauuguacgcugaucgacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacccuugaauuuaacaaugagucuuucaacuggacaggagugacccagaauggcacauccagcgcuugcauucgcagaucuaacaauuccuuuuucagccggcugaacuggcucacccaucugaaguuuaaguauccugcccuuaaugucacgaugcccaacaacgagcaguucgacaaacuguacaucuggggcgugcaccauccugggacagauaaugaccagauuuuucucuaugcgcaagccucuggacgcaucaccguuuccacaaagagaagccagcagaccgugauuccgaacaucggcucccggccccgcgucagaaauauuccuucucggaucagcaucuacuggaccauugugaaacccggggauauccugcugauuaacuccacaggaaaucucaucgcuccucgcggcuacuucaagauuagaagcgggaaaucuuccaucaugcggagcgacgcccccaucggaaaguguaacucugaaugcauuacgccgaauggcagcaucccuaacgacaagcccuuucagaaugugaaccgcauuaccuauggcgcuuguccuagauacgucaaacaaaauacacugaaacuugccaccgggaugcggaacguucccgagaagcagacacgcggaaucuucggcgcgauugccggguuuaucgaaaauggaugggagggcaugguggaugggugguauggauucagacaccagaacuccgagggccggggccaagcugccgaccugaagucuacccaggcugccaucgaucagauuaaugggaaacucaacagacugaucggaaagacgaacgaaaaauuccaccagauugagaaggaauuuagcgagguggaaggccgcauccaagaccuugagaaguacgucgaggauacaaaaauugaccugugguccuauaaugccgaacuccugguggcucuggagaaccagcauaccaucgaucucaccgacagcgaaaugaauaagcuguucgagaaaacaaagaaacagcuucgggaaaacgcggaggauauggggaauggaugcuuuaagauuuaccacaagugugacaacgccugcaucggcucuaucagaaaugggaccuaugaucaugacguuuaccgcgacgaggcucugaacaaucgguuccagauuaaaggcguggaacucaaguccggauacaaagauuggauccuguggauuagcuuugccaucucuugcuuccuucugugugucgcccuccugggcuuuauuaugugggcuugccaaaaggggaacaucagauguaauaucugcauuuga

SEQ ID NO: 186245 - RNA, 1701 nt, Artificial Sequence; identical to SEQ ID NO: 185458
  derived and/or modified sequence opt5 from hemagglutinin__InfluenzaA__ACU80732

SEQ ID NO: 186246 - RNA, 1701 nt, Artificial Sequence; identical to SEQ ID NO: 185458
  derived and/or modified sequence opt5 from hemagglutinin__InfluenzaA__ACU80743

SEQ ID NO: 186247 - RNA, 1701 nt, Artificial Sequence
  derived and/or modified sequence opt5 from hemagglutinin__InfluenzaA__ACU80754
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugguggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacgucgaggauacgaaaaucgaccugugguccuauaaugccgaacuccugguggcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguuuaccgcgacgaggcucugaacaaucgguuccagaucaaaggcguggaacucaaguccggauacaaagauuggauucuguggaucagcuuugccauuucuugcuuccuucugugugucgugcuccugggcuuuaucaugugggccugccaaaaggggaacaucagauguaauauuugcaucuga

SEQ ID NO: 186248 - RNA, 1701 nt, Artificial Sequence
  derived and/or modified sequence opt5 from hemagglutinin__InfluenzaA__ACU80765
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacauucuaaguuuaaguauccugcccugaaugucaccaugcccaacaacgaggaguucgacaaacuuuacauuuggggcgugcaccauccugggacggauaaugaccagaucuuucuguaugcgcaggccuccggacgcauuacaguuagcaccaagagaucccaacagacagugaucccgaacauuggcucucggccccgcgucagaaauaucccuagccggaucuccauuuacuggaccaucgugaaacccggggauauucuccugaucaacagcaccggaaaucugauugcuccucgcggcuacuucaagaucagaucugggaaauccagcaucaugcggucugacgcccccauuggaaaguguaacagcgaaugcaucacaccgaauggcuccauuccuaacgacaagcccuuucagaaugugaaccgcaucacguauggcgcuuguccuagauacgucaaacagaauacccucaagcuggccacagggaugcggaacguucccgaaaaacaaacccgcggaauuuucggcgcgaucgccggguuuaucgagaauggaugggagggcaugguggaugggugguauggauucagacaccagaacucugaaggcauuggccaggcugccgaccuuaagagcacacaagcugccaucgaucagauuaaugggaaacugaaccggcucaucggaaagaccaacgagaaauuccaccagauugaaaaggaguuuuccgaaguggagggcagaauccaggaccuggagaaguacgucgaagauacgaaaauugaccuuuggagcuauaaugccgagcugcucguggcucuggaaaaccaacauacaaucgaucugaccgacucugagaugaauaaacucuucgaaaagaccaagaaacagcugcgcgagaacgcggaggauauggggaauggaugcuuuaagaucuaccacaagugugacaacgccugcauuggcuccauccggaaugggacauaugaucaugacguuuacagagacgaagcucuuaacaaucgcuuccagauuaaaggcguggagcucaagagcggauacaaagauuggauccuguggauuucuuuugccaucuccugcuuccugcuuuguaucgcccugcucggcuuuauuaugugggcuugccagaaggggaacauccgguguaauauuugcaucuga

SEQ ID NO: 186249 - RNA, 1701 nt, Artificial Sequence
  derived and/or modified sequence opt5 from hemagglutinin__InfluenzaA__ACU80787
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaaguuuaaguauccugcccuuaaugucaccaugcccaacaacgagcaguucgacaaacuguacauuuggggcgugcaccauccugggacggauaaugaccagaucuuucucuaugcgcaagccucuggacgcauuacaguuuccaccaagagaagccagcagacagugaucccgaacauuggcucccggccccgcgucagaaauaucccuucucggaucagcauuuacuggaccaucgugaaacccggggauauucugcugaucaacuccaccggaaaucucauugcuccucgcggcuacuucaagaucagaagcgggaaaucuuccaucaugcggagcgacgcccccauuggaaaguguaacucugaaugcaucacaccgaauggcagcauuccuaacgacaagcccuuucagaaugugaaccgcaucacguauggcgcuuguccuagauacgucaaacaaaauacccugaaacuugccacagggaugcggaacguucccgagaagcagacccgcggaauuuucggcgcgaucgccggguuuaucgaaaauggaugggagggcaugauggaugggugguauggauucagacaccagaacuccgagggccggggccaagcugccgaccugaagucuacacaggcugccauugaucagaucaaugggaaacucaacagacugauuggaaagaccaacgaaaaauuccaccagaucgagaaggaauuuagcgagguggaaggccgcauucaagaccuugagaaguacguggaggauacgaaaaucgaccugugguccuauaaugccgaacuccuggucgcucuggagaaccagcauacaauugaucucaccgacagcgaaaugaauaagcuguucgagaaaaccaagaaacagcuucgggaaaacgcggaggauauggggaauggaugcuuuaagaucuaccacaagugugacaacgccugcaucggcucuauuagaaaugggacauaugaucaugacguguaccgcgacgaggcucugaacaaucgguuccagaucaaaggcguugaacucaaguccggauacaaagauuggauucuguggaucagcuuugccauuucuugcuuccuucuguguguggcccuccugggcuuuaucaugugggcuugccaaaaggggaacaucagauguaauauuugcaucuga

SEQ ID NO: 186250 - RNA, 1701 nt, Artificial Sequence; identical to SEQ ID NO: 185458
  derived and/or modified sequence opt5 from hemagglutinin__InfluenzaA__ACU80798

SEQ ID NO: 186251 - RNA, 1701 nt, Artificial Sequence; identical to SEQ ID NO: 185458
  derived and/or modified sequence opt5 from hemagglutinin__InfluenzaA__ACU81103

SEQ ID NO: 186252 - RNA, 1701 nt, Artificial Sequence
  derived and/or modified sequence opt5 from hemagglutinin__InfluenzaA__ACU87270
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugauugaacccggagacaagaucacguucgaggccacaggcaaccugguugugccucgcuacgcguuugccauggaaagaaacgcugggucuggaauuaucaucuccgauacccccgugcaugacugcaauacaaccugucagaccccuaaaggcgccauuaacacaagccuccccuuccaaaauauccacccgauuacgaucggcaagugcccuaaguaugucaaaucuaccaagcugcggcuugcuacagggcugcgcaacgugcccagcauucaguccagaggacucuuuggcgccaucgccggguucaucgagggaggcuggaccgggaugguugacggaugguacggcuaucaucaccagaaugaacagggcucuggguacgcugcggaucugaaaagcacacaaaacgccauugacgagaucaccaauaaggugaacuccgucauugagaaaaugaauacgcaguuuacagcugugggaaaggaguucaaccaccuugagaagcggaucgaaaaucugaacaaaaagguugaugacggcuuccucgauauuuggaccuacaaugccgagcugcuggugcuccuggaaaacgagcgcacccuugacuaucaugauagcaaugucaaaaaccuguacgagaaggugagaucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaaucgggaggagaucgacggggugaaacuugaaucuacacgcauuuaucagauccuggccauuuacuccacgguugcgagcucccucgugcuggucgugucucugggcgcuaucagcuuuuggaugugcuccaacggaucucuccaaugcagaauuuguaucuga

SEQ ID NO: 186253 - RNA, 1701 nt, Artificial Sequence; identical to SEQ ID NO: 185693
  derived and/or modified sequence opt5 from hemagglutinin__InfluenzaA__ACV04228

SEQ ID NO: 186254 - RNA, 1701 nt, Artificial Sequence; identical to SEQ ID NO: 185693
  derived and/or modified sequence opt5 from hemagglutinin__InfluenzaA__ACV04238

SEQ ID NO: 186255 - RNA, 1701 nt, Artificial Sequence
  derived and/or modified sequence opt5 from hemagglutinin__InfluenzaA__ACV04248
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggaaucacagccgcuuguccccaugccggcgccaagagcuuuuauaaaaaucugauuuggcucgugaagaaaggcaacucuuacccuaagcuguccaaaagcuauaucaaugacaaggggaaggagguucuugugcuguggggcauucaccaccccuccaccucugccgaucaacagagccucuaccagaacgcugacgccuacgucuucgugggauccagcagauauucuaaaaaguuuaaaccugagaucgcuauucggccgaaggugcgcgaucaggaagggagaaugaauuacuauuggacacuggucgagcccggagacaaaaucaccuucgaagccacgggcaaccugguugugccucgguacgcguuugccauggagcgcaacgcuggguccggaauuaucaucagcgauacacccgugcaugacugcaauaccacaugucaaaccccuaagggcgccauuaacaccucucuccccuuccacaauauccauccgauuacaaucggcaaaugcccuaaguaugucaagagcacgaaacugagacuugcuaccgggcugcggaacgugcccuccauucagucucgcggacucuuuggcgccaucgccggguucaucgaaggaggcuggacagggaugguugacggaugguacggcuaucaccaccagaaugagcagggcagcggguacgcugcggaucugaaguccacccaaaacgccauugacgagaucacaaauaaagugaacagcgucauugaaaagaugaauacccaguuuacggcugugggaaaagaguucaaccaucuugaaaagagaaucgagaaucugaacaagaaaguugaugacggcuuccucgauauuuggacauacaaugccgaacugcuggugcuccuggagaacgagcggacccuugacuaucacgauucuaaugucaagaaccuguacgaaaaagugcgcucccagcucaagaacaaugccaaagagaucgggaacggauguuuugaguucuaucauaagugcgacaauaccuguauggaaagcgucaagaacggcacauacgauuauccuaaauacucugaagaggcuaagcugaauagagaggaaaucgacggggugaaacuugaguccacccggauuuaucagauccuggccauuuacagcacaguugcguccucucucgugcuggucgugagccugggcgcuaucuccuuuuggaugugcucuaacggaagccuccaaugccgcauuuguaucuga

SEQ ID NO: 186256 - RNA, 1701 nt, Artificial Sequence; identical to SEQ ID NO: 185693
  derived and/or modified sequence opt5 from hemagglutinin__InfluenzaA__ACV04258

SEQ ID NO: 186257 - RNA, 1701 nt, Artificial Sequence; identical to SEQ ID NO: 185693
  derived and/or modified sequence opt5 from hemagglutinin__InfluenzaA__ACV04268

SEQ ID NO: 186258 - RNA, 1701 nt, Artificial Sequence; identical to SEQ ID NO: 185693
  derived and/or modified sequence opt5 from hemagglutinin__InfluenzaA__ACV04278

SEQ ID NO: 186259 - RNA, 1701 nt, Artificial Sequence; identical to SEQ ID NO: 185693
  derived and/or modified sequence opt5 from hemagglutinin__InfluenzaA__ACV04288

SEQ ID NO: 186260 - RNA, 1701 nt, Artificial Sequence
  derived and/or modified sequence opt5 from hemagglutinin__InfluenzaA__ACV04298
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccggugacgaucggcaagugcccuaaguauguuaaaucuaccaagcugagacuugcuacagggcugcggaacgugcccagcauucagucccgcggacucuuuggcgccaucgccggguucauugagggaggcuggaccgggauggucgacggaugguacggcuaucaucaccagaaugaacaaggcucuggguacgcugcggaucugaaaagcacacagaacgccaucgacgagaucaccaauaaggugaacuccguuauugagaaaaugaauacgcaguuuacagcugugggaaaggaguucaaccaccuugagaagagaaucgaaaaucugaacaaaaaggucgaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccguuaaaaacggcaccuacgauuauccuaaguacagcgaggaagcuaaacugaauagagaggagauugacggggugaaacuugaaucuacacggaucuaucaaauccuggccauuuacuccacggucgcgagcucccucgugcugguugugucucugggcgcuaucagcuuuuggaugugcuccaacggaucucuccagugccgcauuuguaucuga

SEQ ID NO: 186261 - RNA, 1701 nt, Artificial Sequence; identical to SEQ ID NO: 185693
  derived and/or modified sequence opt5 from hemagglutinin__InfluenzaA__ACV04308

SEQ ID NO: 186262 - RNA, 1701 nt, Artificial Sequence
  derived and/or modified sequence opt5 from hemagglutinin__InfluenzaA__ACV04318
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccauaauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186263 - RNA, 1701 nt, Artificial Sequence; identical to SEQ ID NO: 185693
  derived and/or modified sequence opt5 from hemagglutinin__InfluenzaA__ACV04328

SEQ ID NO: 186264 - RNA, 1701 nt, Artificial Sequence; identical to SEQ ID NO: 185693
  derived and/or modified sequence opt5 from hemagglutinin__InfluenzaA__ACV04338

SEQ ID NO: 186265 - RNA, 1701 nt, Artificial Sequence; identical to SEQ ID NO: 185935
  derived and/or modified sequence opt5 from hemagglutinin__InfluenzaA__ACV04358

SEQ ID NO: 186266 - RNA, 1701 nt, Artificial Sequence
  derived and/or modified sequence opt5 from hemagglutinin__InfluenzaA__ACV04368
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuugucagcugagaggaguugcgccccuccaucugggcaagugcaacaucgccggguggauucugggaaauccugagugugaaucucucagcacagcuuccucuuggagcuacaucguggagaccuccucuagcgacaacggcacgugcuauccgggggauuuuauugacuacgaagaacugcgggagcaacuuuccagcgucucuuccuucgaacgcuuugagaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaagugcuuguccuguggggaauccaccaccccuccaccucugccgaucagcagagccucuaccagaacgcugacgccuacguguucgugggcacauccagauauagcaaaaaguuuaaaccugagauugcuauccggccgaagguccgcgaucaagaggggagaaugaauuacuauuggacccugguugaacccggagacaaaauuacguucgaggccacaggcaaccugguggugccucgguacgcguuugccauggaacgcaacgcugggucuggaaucauuaucuccgauacccccguccaugacugcaauacaaccugucagaccccuaagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgagggaggcuggaccgggaugguggacggaugguacggcuaucaucaccaaaaugaacagggcucuggguacgcugcggaucuuaagagcacacagaacgccaucgacgagauuaccaauaaagucaacuccgugaucgagaagaugaauacgcaguuuacagcuguuggaaaagaguucaaccaccuggagaagagaauugaaaaucugaacaagaaaguggaugacggcuuccucgauaucuggaccuacaaugccgagcugcugguccuccuggaaaacgagcggacccuugacuaucaugauagcaaugugaagaaccuguacgagaaaguccgcucucaacucaagaacaaugccaaagaaauugggaacggauguuuugaguucuaucacaagugcgacaauacauguauggaauccgugaagaacggcaccuacgauuauccuaaauacagcgaggaagcuaagcugaauagagaggagaucgacgggguuaaacuugaaucuacacggaucuaucagauucuggccaucuacuccacgguggcgagcucccucguccuggugguuucucugggcgcuauuagcuuuuggaugugcuccaacggaucucuccagugccgcaucuguauuuga

SEQ ID NO: 186267 - RNA, 1701 nt, Artificial Sequence
  derived and/or modified sequence opt5 from hemagglutinin__InfluenzaA__ACV04378
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacauccccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcugaucgucucucugggcgcuauuagcuuuuggaugugcuccaacggaucucuccagugccgcaucuguauuuga

SEQ ID NO: 186268 - RNA, 1701 nt, Artificial Sequence; identical to SEQ ID NO: 185935
  derived and/or modified sequence opt5 from hemagglutinin__InfluenzaA__ACV04388

SEQ ID NO: 186269 - RNA, 1701 nt, Artificial Sequence; identical to SEQ ID NO: 185693
  derived and/or modified sequence opt5 from hemagglutinin__InfluenzaA__ACV04398

SEQ ID NO: 186270 - RNA, 1701 nt, Artificial Sequence; identical to SEQ ID NO: 185937
  derived and/or modified sequence opt5 from hemagglutinin__InfluenzaA__ACV04408

SEQ ID NO: 186271 - RNA, 1701 nt, Artificial Sequence; identical to SEQ ID NO: 185693
  derived and/or modified sequence opt5 from hemagglutinin__InfluenzaA__ACV04489

SEQ ID NO: 186272 - RNA, 1701 nt, Artificial Sequence; identical to SEQ ID NO: 185693
  derived and/or modified sequence opt5 from hemagglutinin__InfluenzaA__ACV04499

SEQ ID NO: 186273 - RNA, 1701 nt, Artificial Sequence; identical to SEQ ID NO: 185873
  derived and/or modified sequence opt5 from hemagglutinin__InfluenzaA__ACV04509

SEQ ID NO: 186274 - RNA, 1701 nt, Artificial Sequence; identical to SEQ ID NO: 185693
  derived and/or modified sequence opt5 from hemagglutinin__InfluenzaA__ACV04519

SEQ ID NO: 186275 - RNA, 1701 nt, Artificial Sequence; identical to SEQ ID NO: 185693
  derived and/or modified sequence opt5 from hemagglutinin__InfluenzaA__ACV04529

SEQ ID NO: 186276 - RNA, 1701 nt, Artificial Sequence; identical to SEQ ID NO: 185693
  derived and/or modified sequence opt5 from hemagglutinin__InfluenzaA__ACV04549

SEQ ID NO: 186277 - RNA, 1701 nt, Artificial Sequence; identical to SEQ ID NO: 185693
  derived and/or modified sequence opt5 from hemagglutinin__InfluenzaA__ACV04559

SEQ ID NO: 186278 - RNA, 1701 nt, Artificial Sequence; identical to SEQ ID NO: 185693
  derived and/or modified sequence opt5 from hemagglutinin__InfluenzaA__ACV04579

SEQ ID NO: 186279 - RNA, 1701 nt, Artificial Sequence
  derived and/or modified sequence opt5 from hemagglutinin__InfluenzaA__ACV04751
auggaggccauccugguggucaugcucuacaccuucgcuacagccaacgcggacacgcugugcauuggcuaucacgcuaauaacagcaccgauacaguugacaccgugcuugaaaagaaugugacagucacccauuccgugaaccugcucgaggauaaacacaaugggaagcuguguaaacuuagaggaguugcgccccugcggcucggcaagugcaacaucgccggguggauucugggaaauccugaaugugagucucugagcacagcuuccucuuggagcuacaucguggaaaccuccucuagcgacaacggcacgugcuauccgggggauuuuauugacuacgaggagcuccgcgaacagcuguccagcgucucuuccuucgagagauuugaaaucuuccccaaaaccagcucuuggccuaaucaugauuccaacaagggagugacagccgcuuguccccacgccggcgccaagagcuuuuauaaaaaucuuaucuggcugguuaagaaaggcaacucuuacccuaagcucuccaaaagcuauauuaaugacaaggggaaggaggugcugguccuuuggggaauccaucaccccuccaccucugccgaucaacagagccuguaccagaacgcugacgccuacguguucgugggcacaucccgguauagcaaaaaguuuaaaccugagauugcuauccgcccgaaggucagagaucaggaagggcggaugaauuacuauuggacccucguugagcccggagacaaaauuacguucgaagccacaggcaaccugguggugccucgcuacgcguuugccauggagagaaacgcugggucuggaaucauuaucuccgauacccccguccacaauugcaacacaaccugucaaaccccuaagggcgccaucaauacaagccugcccuuccagaacauucauccgaucacgauuggcaaaugcccuaaguaugugaagucuaccaaacuccggcuggcuacagggcuucgcaauguucccagcauccaguccagaggacuguuuggcgccauugccggguucaucgaaggaggcuggaccgggaugguggacggaugguacggcuaucaccaucagaacgagcaaggcucuggguacgcugcggaccucaagagcacacagaaugccaucgaugagauuaccaacaaagucaauuccgugaucgaaaagaugaacacgcaguuuacagcuguuggaaaagaguucaaucaccuggaaaagcggauugagaaccuuaauaagaaaguggacgauggcuuccuggacaucuggaccuacaacgccgaacuccugguccugcucgagaaugagcgcacccuggauuaucacgacagcaacgugaagaaccuuuacgaaaaagucagaucucagcugaagaauaacacaaaagagauugggaauggauguuuugaguucuaucauaagugcgauaacaccuguauggaauccgugaagaauggcacauacgacuauccuaaauacagcgaagaggccaagcucaaccgggaggaaaucgaugggguuaaacuggagucuacgcgcaucuaucaaauucuugcuaucuacuccaccguggccagcucccugguccucgugguuucucugggcgcgauuagcuuuuggaugugcuccaauggaucucugcagugcagaaucuguauuuga

SEQ ID NO: 186280 - RNA, 1701 nt, Artificial Sequence
  derived and/or modified sequence opt5 from hemagglutinin__InfluenzaA__ACV04752
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaacauccucgaggauaaacacaaugggaagcuguguaaacuuagaggaguugcgccccugcaucucggcaagugcaacauugccggguggauccuggaaaauccugagugugaaucucugagcacagcuuccucuuggagcuacauuguggagaccuccucuagcgacaacggaacgugcuauccgggcgauuuuaucgacuacgaggaacuccgggagcagcuguccagcgucucuuccuucgaacgcuuugagaucuuccccaaaaccagcucuuggccuaaucacgauuccaacaagggggugacagccgcuuguccccaugccggagccaagagcuuuuauaaaaaucuuauuuggcugguuaagaaaggcaacucuuacccuaagcucuccaaaagcuauaucaaugacaagggcaaggaggugcugguccuuugggggauucaccaccccuccaccucugccgaucaacagagccuguaccagaacgcugacgccuacguguucgugggauccagcagauauucuaaaaaguuuaaaccugaaaucgcuauucggccgaagguccgcgaucaggagggcagaaugaauuacuauuggacacucguugaacccggggacaaaaucaccuucgaggccacgggaaaccugguggugccucgguacgcguuugccauggaacgcaacgcuggcuccgggauuaucaucagcgauacacccguccaugacugcaauaccacaugucaaaccccuaagggagccauuaacaccucucugcccuuccacaauauccauccgauuacaaucggcaaaugcccuaaguauguuaagagcacgaaacucagacuggcuaccggccuucggaacgugcccuccauucagucucgcgggcuguuuggagccaucgccggcuucaucgaagggggauggacaggcaugguggacgggugguacggauaucaccaccagaaugagcagggcagcggcuacgcugcggaucucaaguccacccaaaacgccauugacgaaaucacaaauaaagucaacagcgugauugagaagaugaauacccaguuuacggcuguugggaaagaguucaaccaucuggagaagagaaucgaaaaucuuaacaagaaaguggaugacggauuccuggauauuuggacauacaaugccgagcuccugguccugcucgagaacgaacggacccuggacuaucacgauucuaaugugaagaaccuuuacgagaaaguccgcucccagcugaagaacaaugccaaagaaaucggcaacggguguuuugaguucuaucauaagugcgacaauaccuguauggaaagcgugaagaacggaacauacgauuauccuaaauacucugaggaggcuaagcucaauagagaagagaucgacggcguuaaacuggaauccacccggauuuaucagauccuugccauuuacagcacaguggcguccucucugguccucgugguuagccugggggcuaucuccuuuuggaugugcucuaacggcagccugcaaugccgcauuuguaucuga

SEQ ID NO: 186281 - RNA, 1701 nt, Artificial Sequence
  derived and/or modified sequence opt5 from hemagglutinin__InfluenzaA__ACV04753
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcacauccagauauagcaaaaaguuuaaaccugagauugcuauccggccgaagguccgcgauagagaagggcggaugaauuacuauuggacccugguugagcccggagacaaaauuacguucgaagccacaggcaaccugguggugccucgcuacgcguuugccauggagagaaacgcugggucuggaaucauuaucuccgauacccccguccaugacugcaauacaaccugucagaccccuaagggcgccaucaacacaagccuccccuuccaaaauauucacccgaucacgauuggcaaaugcccuaaguaugugaagucuaccaaacugcggcuugcuacagggcugcgcaacguucccagcauccaguccagaggacucuuuggcgccauugccggguucaucgaaggaggcuggaccgggaugguggacggaugguacggcuaucaucaccagaaugagcagggcucuggguacgcugcggaucuuaagagcacacaaaacgccaucgacgagauuaccaauaaagucaacuccgugaucgaaaagaugaauacgcaguuuacagcuguuggaaaagaguucaaccaccuugaaaagcggauugagaaucugaacaagaaaguggaugacggcuuccucgauaucuggaccuacaaugccgaacugcugguccuccuggagaacgagcgcacccuugacuaucaugauagcaaugugaagaaccuguacgaaaaagucagaucucagcucaagaacaaugccaaagagauugggaacggauguuuugaguucuaucacaagugcgacaauacauguauggaauccgugaagaacggcaccuacgauuauccuaaauacagcgaagaggcuaagcugaaucgggaggaaaucgacgggguuaaacuugagucuacacgcaucuaucagauucuggccaucuacuccacgguggcgagcucccucguccuggugguuucucugggcgcuauuagcuuuuggaugugcuccaacggaucucuccaaugcagaaucuguauuuga

SEQ ID NO: 186282 - RNA, 1701 nt, Artificial Sequence
  derived and/or modified sequence opt5 from hemagglutinin__InfluenzaA__ACV04754
auggaggccauccuggugguccuccuguacaccuucgcuacagccaacgcggacacgcuuugcauuggcuaucacgcuaauaacagcaccgauacaguugacaccgugcuggaaaagaaugugcccgucacacauuccgugaaccuccugaaagauaagcacaaugggaaacuuuguaagcugagaggaguugccccucuccaucugggcaaaugcaacaucgccggguggauucugggaaauccggagugugaaucucucagcaccgcuuccucuuggagcuacaucguggagacauccucuagcgacaacgggaccugcuaucccggcgauuuuauugacuacgaagaacugcgggagcagcuuuccagcgucucuuccuucgaacgcuuugagaucuucccuaagacgagcucuuggcccaaucacgaauccaacaagggagugaccgccgcuuguccucaugccggcgcgaaaucuuuuuauaagaaucugaucuggcucguuaaaaagggcaacagcuaccccaaacuguccaagagcuauauuaaugauaaggggaaagaggugcuuguccuguggggaauccaccacccuuccacaucugccgaccaacagagccucuaccagaacgcugaugccuacguguucgugggcaccuccagauauagcaagaaauuuaagccggagauugcuauccggcccaaaguccgcgaccaggaagggagaaugaauuacuauuggacacugguugagccuggagauaagauuaccuucgaagccacgggcaaccugguggugccccgguacgcguuugccauggagcgcaacgcugggucuggaaucauuaucuccgacacaccuguccaugauugcaauaccacaugucaaacccccaaaggcgccaucaacaccagccucccguuccagaauauucacccuaucacaauuggcaagugccccaaguaugugaaaucuacgaagcugagacuugcuaccgggcugcggaacguuccuagcauccagucccgcggaguguuuggcgccauugccggguucaucgaaggaggcuggacagggauggucgacggaugguacggcuaucaucaccagaaugagcaaggcucuggguacgcugcggaccucaaaagcacccagaacgccaucgaugagauuacaaauaaggugaacuccguuaucgagaaaaugaauacccaguuuacggcugugggaaaggaguucaaccaccuggaaaagagaauugagaaucuuaacaaaaaggucgacgauggcuuccuggacaucuggacauacaaugccgaacuccuggugcugcucgagaacgagcggacccuggauuaucaugacagcaaugucaaaaaccuuuacgaaaaggugcgcucucagcugaaaaacaaugccaaggagauugggaacggauguuuugaguucuaucacaagugcgauaauaccuguauggaauccguuaaaaacggcacauacgacuaucccaaguacagcgaagaggcuaaacucaauagagaggaaaucgauggggugaagcuggagucuacccggaucuaucaaauucuugccaucuacuccacagucgcgagcucccuggugcucguugugucucugggcgcuauuagcuuuuggaugugcuccaacggaucucugcagugccgcaucuguauuuga

SEQ ID NO: 186283 - RNA, 1701 nt, Artificial Sequence; identical to SEQ ID NO: 186178
  derived and/or modified sequence opt5 from hemagglutinin__InfluenzaA__ACV04755

SEQ ID NO: 186284 - RNA, 1701 nt, Artificial Sequence; identical to SEQ ID NO: 185873
  derived and/or modified sequence opt5 from hemagglutinin__InfluenzaA__ACV33084

SEQ ID NO: 186285 - RNA, 1701 nt, Artificial Sequence; identical to SEQ ID NO: 185693
  derived and/or modified sequence opt5 from hemagglutinin__InfluenzaA__ACV33094

SEQ ID NO: 186286 - RNA, 1701 nt, Artificial Sequence; identical to SEQ ID NO: 185693
  derived and/or modified sequence opt5 from hemagglutinin__InfluenzaA__ACV33104

SEQ ID NO: 186287 - RNA, 1701 nt, Artificial Sequence; identical to SEQ ID NO: 185693
  derived and/or modified sequence opt5 from hemagglutinin__InfluenzaA__ACV33114

SEQ ID NO: 186288 - RNA, 1701 nt, Artificial Sequence; identical to SEQ ID NO: 185693
  derived and/or modified sequence opt5 from hemagglutinin__InfluenzaA__ACV33124

SEQ ID NO: 186289 - RNA, 1701 nt, Artificial Sequence; identical to SEQ ID NO: 185693
  derived and/or modified sequence opt5 from hemagglutinin__InfluenzaA__ACV33134

SEQ ID NO: 186290 - RNA, 1701 nt, Artificial Sequence; identical to SEQ ID NO: 186255
  derived and/or modified sequence opt5 from hemagglutinin__InfluenzaA__ACV33144

SEQ ID NO: 186291 - RNA, 1701 nt, Artificial Sequence; identical to SEQ ID NO: 185693
  derived and/or modified sequence opt5 from hemagglutinin__InfluenzaA__ACV33154

SEQ ID NO: 186292 - RNA, 1701 nt, Artificial Sequence; identical to SEQ ID NO: 185693
  derived and/or modified sequence opt5 from hemagglutinin__InfluenzaA__ACV33164

SEQ ID NO: 186293 - RNA, 1701 nt, Artificial Sequence; identical to SEQ ID NO: 185693
  derived and/or modified sequence opt5 from hemagglutinin__InfluenzaA__ACV33174

SEQ ID NO: 186294 - RNA, 1701 nt, Artificial Sequence; identical to SEQ ID NO: 185680
  derived and/or modified sequence opt5 from hemagglutinin__InfluenzaA__ACV41981

SEQ ID NO: 186295 - RNA, 1701 nt, Artificial Sequence; identical to SEQ ID NO: 185719
  derived and/or modified sequence opt5 from hemagglutinin__InfluenzaA__ACV41991

SEQ ID NO: 186296 - RNA, 1701 nt, Artificial Sequence; identical to SEQ ID NO: 185719
  derived and/or modified sequence opt5 from hemagglutinin__InfluenzaA__ACV42001

SEQ ID NO: 186297 - RNA, 1701 nt, Artificial Sequence; identical to SEQ ID NO: 185693
  derived and/or modified sequence opt5 from hemagglutinin__InfluenzaA__ACV42008

SEQ ID NO: 186298 - RNA, 1701 nt, Artificial Sequence; identical to SEQ ID NO: 185693
  derived and/or modified sequence opt5 from hemagglutinin__InfluenzaA__ACV42018

SEQ ID NO: 186299 - RNA, 1701 nt, Artificial Sequence; identical to SEQ ID NO: 185340
  derived and/or modified sequence opt5 from hemagglutinin__InfluenzaA__ACV49501

SEQ ID NO: 186300 - RNA, 1701 nt, Artificial Sequence
  derived and/or modified sequence opt5 from hemagglutinin__InfluenzaA__ACV49512
augaagaccaucauugcccugagcuacaucuucugccucgcucugggccaggaccuucccgggaacgauaauuccacagccacgcugugucucggacaccaugcggugccuaacggcacccuggucaaaacaauuaccgacgaucaaaucgagguuacaaaugcuaccgaacuugugcagucuagcuccacagggaagauuugcaacaauccgcacagaauccuggacggaaucgauuguacccucauugacgcccugcugggcgauccccauugcgacguguuucagaacgagacgugggaucucuucgucgaacggucuaaagccuuuagcaauuguuauccuuacgacgugcccgauuaugcuucccugcgcucucuuguugccagcuccgggacccuggaguucaucacagaaggauuuaccuggacaggcgugacccagaacggcgggagcaaugcuugcaagagaggaccuggcucuggguucuuuucccggcucaacuggcugacgaaaagcggaucuacauaccccguccuuaaugugaccaugccuaacaaugacaacuucgauaagcuguauauuuggggcguucaccauccguccacaaaucaagagcagaccagccucuacgugcaggccucugggcgcgucaccguguccacaagacggagccagcaaacgaucauucccaacaucgagucccgcccuugggugagaggacugucuagccggauuuccaucuauuggaccaucgucaagcccggcgacguucuggugauuaacagcaauggcaaccucaucgcgccucgcggguacuuuaaaaugagaacaggaaagucuuccauuaugcggagcgacgcccccaucgauaccuguauuucugaaugcaucacaccgaauggcagcaucccuaacgacaaacccuuccagaaugugaacaagauuaccuacggggcuuguccuaaauaugucaagcagaauacgcugaaacuugccacaggaaugcgcaacgugcccgagaaacagaccagaggccuguuuggggcuaucgccggauucauugaaaauggcugggagggcaugaucgaugggugguacggauuucggcaccaaaacuccgagggcaccgggcaggcggccgaccucaagucuacacaggcugccauugaucaaaucaauggaaaacugaaccgcguuaucgaaaagaccaaugagaaauuccaccagauugaaaaggaguucagcgaaguggagggcagaauccaggaccuugagaaauaugucgaagauacaaagauugaccugugguccuacaacgcugagcuccugguggcccuggaaaaucagcauacgaucgaucucaccgacagcgagaugaacaagcuguuugaaaagacacggagacaacuucgcgagaacgccgaggauauggggaauggcugcuucaagauuuaucacaaaugugacaacgcuugcaucgaaucuauucggaauggaaccuacgaccaugauguuuauagagacgaggcgcugaacaaucgcuuucagaucaaggauguggaacucaaauccggcuacaaggacuggauccuguggauuagcuucgccaucucuugcuuucuucugugugucgugcuccugggguucauuaugugggcuugccagcggggaaacaucagauguaauauuugcaucuga

SEQ ID NO: 186301 - RNA, 1701 nt, Artificial Sequence; identical to SEQ ID NO: 185353
  derived and/or modified sequence opt5 from hemagglutinin__InfluenzaA__ACV49523

SEQ ID NO: 186302 - RNA, 1698 nt, Artificial Sequence
  derived and/or modified sequence opt5 from hemagglutinin__InfluenzaA__ACV49545
augaaggccaaccugcucgugcugcuuugcgcucuggccgcggcugacgccgauaccaucuguauuggcuaccacgccaauaacagcacagacacggucgauaccguucucgagaaaaaugugacagugacccauuccgucaaccugcuugaagacucucacaaugggaagcugugcagacucaaaggaaucgcuccccugcagcugggcaaguguaacauugccggguggcuccugggaaauccugagugcgauccgcuucugcccgugcggagcugguccuauaucguugaaacaccuaacucugagaauggcauuuguuaccccggggacuucaucgauuaugaagaacuccgcgagcaacugagcuccgugucuagcuuugaaagauucgagaucuuuccuaaagaauccagcuggcccaaccauaauaccaacggagucacagcugccugcucucacgagggcaaguccagcuucuaccggaaucuucuguggcucaccgagaaggaaggcucuuauccuaaacugaagaacuccuacgugaauaaaaaggggaaagagguucuggugcucuggggcauucaucacccgcccaacagcaaggaacagcagaaccuguaucagaaugagaacgcguacgucucuguggugacguccaauuacaaccgcagauuuaccccugaaaucgccgagcggcccaagguccgcgaccaagcuggaagaaugaauuauuacuggacacuucugaaaccuggggauaccauuaucuucgaggccaacggaaaucucauugcucccauguaugccuuugcgcugagccggggcuucggguccggaaucauuacaucuaacgccagcaugcacgaauguaauaccaagugccagacgccgcuuggcgcuaucaacuccagccugccuuaccagaauauccaucccguuacaauuggcgaguguccuaaauaugugcgcucugccaagcucagaauggugaccgggcugcggaacauccccuccauucagagccgcggacuguuuggcgcuaucgccggguucauugaaggaggcuggacagggaugaucgacggaugguacggcuaucaccaucaaaaugagcagggcucuggguacgccgcugaucagaaaagcacccagaacgcgaucaauggaauuaccaacaaggucaacacagugaucgagaaaaugaauauucaauuuacggccguuggcaaggaguucaacaagcucgagaaaagaauggaaaaucugaacaagaaaguggacgauggguuucuugacaucuggaccuacaaugcugagcugcucguccugcuugaaaacgagcggacacuggacuuccacgauuccaaugugaagaaccucuaugaaaaaguuaagucucagcugaagaauaacgccaaagagauuggaaauggcugcuucgaguuuuaccacaagugugacaacgaaugcauggagagcgugcgcaaugggaccuaugauuaccccaaauauuccgaagagagcaagcugaacagagagaaagucgacggcgugaagcucgaaucuaugggaaucuaccagauccuggccauuuauuccacagucgcuagcucucuugugcugcucguuucccugggcgccaucagcuucuggaugugcuccaaugggucucugcaaugucggauuugcaucuga

SEQ ID NO: 186303 - RNA, 1701 nt, Artificial Sequence
  derived and/or modified sequence opt5 from hemagglutinin__InfluenzaA__ACV49556
augaaggccagacugcucauccugcuuugcgcucuggccgcgaccgacgcugauacaauuuguaucggcuaccacgccaacaauagcacggacaccguggauacaguccucgagaaaaacguuaccgugacacauuccgugaaucugcuugaagacucucacaacgggaagcugugccggcucaaaggaauugcuccccugcagcugggcaaguguaauaucgccggguggauucucggaaacccugagugcgauagccugcuuccggccuccucuuggagcuauaucgucgaaacccccaauuccaaaaacggcaucuguuacccuggggacuucauugauuaugaggaacugcgcgagcaacucucuagcguguccagcuuugagagauucgaaaucuuucccaaggagucuuccuggccuaagcauagcacaaccaaaggaguuacggcugccugcucucacgcgggcaaguccagcuucuaccggaaucugcuuuggcugaccaaaaaggaagacucuuaucccaaacucuccaacagcuacgugaauaagaagggcaaagagguccuggugcuguggggaguucaucacccuuccucuagcaaggagcagcagacacucuaucagaacgaaaaugccuacguguccgucgugagcucuaacuacaaucgcagauuuauuccggagaucgcugaacggcccgaggugaaagaucaagccgggcgcauuaacuauuacuggacccugcuugaaccuggcgacacaaucauuuucgaggcuaacgggaaucuggucgcccccugguaugcguuugcccucuccagaggauucggcagcgggaucaucaccucuaacgcuagcaugcacgaguguaauacgaagugccagacaccucagggagccauuaacuccucucugcccuuucagaauauccauccgguuaccauuggcgaauguccuaaauacgucaagagcgcuaaacuucggauggugacaggccugcgcaacauccccuccauucaaagcagaggacucuucggggccaucgccggcuuuaucgaagggggauggaccggcaugauugaugggugguauggauaccaccaucagaaugaacagggcucuggcuaugcugcggaccagaaguccacccaaaacgccaucaaugggauuacaaacaaggugaauagcgugaucgagaaaaugaacacgcaguucaccgcuguuggaaaggaauuuaauaaccuggagaaacggauggagaaucugaacaagaaaguggaugacggcuuccucgacauuuggacauacaacgccgaacugcuuguccugcucgagaaugaacgcacccuggauuuccacgacucuaacgugaagaaucuuuacgagaagguuaaaauccagcugaagaacaaugccaaagaaaucgggaacggaugcuuugaguucuaucacaagugugauaaugagugcauggaauccgugagaaacggcacauacgacuauccuaaauacagcaaggaguccaagcucaaucgggagaaaauugauggggucaagcuggagucuaugggcguguaucaaauccuggcuauuuacagcaccgucgccuccucucucgugcugcuuguuagccugggagcgaucuccuuuuggaugugcagcaacggcucucuccagugucgcauuugcaucuga

SEQ ID NO: 186304 - RNA, 1701 nt, Artificial Sequence
  derived and/or modified sequence opt5 from hemagglutinin__InfluenzaA__ACV49567
augaaggccaaacugcucauccugcuuugcgcucugaccgccacagacgcggauacgauuuguaucggcuaccacgcuaacaauagcaccgacacaguggauaccguccucgagaagaacguuacagugacccauuccgugaaucugcuugaagacucucacaacgggaaacugugcagacucaagggaauugccccgcugcagcugggcaaauguaauaucgccggguggauucucggaaacccugagugcgaaagccugcuuuccaagcggucuuggagcuauaucgcugagacacccaauuccgaaaacggcgccuguuaccccggggauuucgcugacuaugaggagcugcgcgaacaacucucuagcgucuccagcuuugagagauucgaaaucuuuccuaaggagcggucuuggcccaaacauaauauuacccgcggagugacggccgcgugcucccacgccggcaagagcucuuucuacaaaaaccugcuuuggcugaccgagacagauggcuccuauccuaagcucagcaaaucuuacguuaauaacaaggaaaaggaggugcugguccuguggggagugcaucaccccuccaauaucgaagaccagaaaacccucuauagaaaggagaacgcuuacguuagcguggucuccucuaauuacaaccggcgcuuuacaccugaaauugccgagagaccgaaagugcgggggcaggcuggccgcaucaacuauuacuggacccugcuugagcccggggauacgauuaucuucgaagccaauggaaaccugauugcgccuugguaugccuuugcucucagcagagacuucggcuccgggaucaucacaagcaaugccucuauggaugagugugacaccaagugccagacaccccaaggagcuauuaacuccagccugccuuuucagaauauccaccccgugaccauuggcgaauguccgaaauacgucaagucuaccaaacuucggaugguuacaggccugcgcaacaucccuagcauucaguccagaggacucuucggggccaucgccggcuuuaucgaagggggauggacgggcaugauugaugggugguauggauaccaucaccagaaugaacaaggcucuggcuaugcugcggaccaaaagagcacccagaacgccaucaauuggauuacaaacaaggucaauuccgugaucgagaaaaugaacacccaguucacagcuguggggaaggaguuuaauaaacuggaaaagcggauggagaaccugaauaaaaagguggacgauggauuccucgacauuuggaccuacaacgccgaacugcuuguucugcucgagaacgaacgcacgcuggauuuccaugacagcaaugugaagaaccuuuacgagaaagucaagaaucagcugagaaacaaugccaaagagaucggcaacgggugcuuugaguucuaucacaaguguaauaacgagugcauggaaucugugaaaaauggaacauacgauuaucccaaguacuccgaggagagcaagcucaaccgggagaaaaucgacggcguuaagcuggaaucuauggggguguaucagauucuggcuaucuacuccaccgucgccagcucccucgugcugcuugucucucugggcgcgauuagcuuuuggaugugcuccaauggaucucuccaguguagaaucugcauuuga

SEQ ID NO: 186305 - RNA, 1689 nt, Artificial Sequence
  derived and/or modified sequence opt5 from hemagglutinin__InfluenzaA__ACV49578
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucagagugcccgaauggucuuacaucauggagaaagagaacccuaaguauagccugugcuaccccggguccuuuaaugauuaugaggaacuuaagcaucugcucucuagcgucaaacacuucgaaaaggugaaaauucugccuaaggaccgguggacacaacauaccacaaccggaggcucccgcgccugugccguuucuggcaaccccagcuuuuucagaaauaugguguggcuuacgaaaaaggggccuaacuacccggucgcuaagggauccuauaauaacaccagcggcgagcagaugcugaucauuuggggagugcaccaccccaucgaugaggccgaacagauugcucucuaccagaaaguugggacauacgugucugccuccaccagcacacugaauaagcggucuaccccugagaucgcggcccgccccgaagucaacggccugggguccagaauggaguuuagcuggacgcuccuggacaugugggauacaaucaauuucgaaucuaccggaaaccuuguggcuccugaguauggcuuuaaaauuuccaagcggggcagcuccgggaucaugaaaacagagggaacccuggaaaacugcgagaccaagugucaaacaccccucggcgccauuaauacgacccugccguuccauaacgugcacccucuuacaaucggggaaugccccaaauacgucaagucugagaagcugguucucgcuaccggacugcgcaaugugccucagauugaaagcagaggccuguuuggggccaucgcgggauucaucgagggcggcuggcaggggaugguggacggaugguauggcuaccaucacuccaacgaucaggggagcggauaugccgcugacaaagagucuacacaaaaggccuuugauggcauuaccaauaaagucaacuccgugaucgaaaagaugaauacgcaguucgaggcuguugggaaagaauuuagcaaccucgagaagcggcuggaaaaucuuaacaagaaaauggaggacggcuuccuggacguguggacauacaaugccgagcuccugguccuuauggaaaacgagcgcacccuggauuuccacgacucuaaugugaagaaccucuaugauaaaguuagaaugcagcugcgggacaaugugaaggaacugggaaacggcuguuuugaguucuaccauaaaugcgaugacgaguguauggauagcgucaagaacgggaccuacgacuaucccaaguacgaagaggaauccaaacucaaucgcaacgagauuaagggagugaaacugucuagcaugggcgucuaucagauccuugccauuuacgcuacaguggcggggucccugagccucgccaucaugauggcuggaaucucuuuuuggaugugcuccaauggcagccugcaaugcagaauuuguaucuga

SEQ ID NO: 186306 - RNA, 1689 nt, Artificial Sequence; identical to SEQ ID NO: 186305
  derived and/or modified sequence opt5 from hemagglutinin__InfluenzaA__ACV49589

SEQ ID NO: 186307 - RNA, 1689 nt, Artificial Sequence
  derived and/or modified sequence opt5 from hemagglutinin__InfluenzaA__ACV49600
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaggaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacggagaagggauccaacuauccugucgcuaaaggcagcuacaauaacaccucuggggagcagaugcugaucauuuggggagugcaccacccgaaugacgaaacagagcagcggacccucuaucagaacguuggcacauacguguccgucgggaccagcacgcugaauaagcgcucuacacccgaaaucgccaccagaccuaaggugaacggacaaggcggccggauggaguuuuccuggacacugcucgauaugugggacaccauuaacuucgaaagcaccgggaaucugaucgcucccgaguacggauuuaaaaucucuaagcgcggcuccagcgggauuaugaaaacagagggaacgcuugaaaacugcgagaccaagugucagacaccucugggcgccaucaauaccacacuccccuuccauaacgugcacccgcugaccauuggggaaugcccuaaauaugucaaguccgagaaacuuguucuggcgacgggacucagaaaugugccccagaucgaaucucggggccuguuuggcgccauugcuggguucaucgagggaggcuggcaggggaugguggauggaugguacggcuaucaucacagcaacgaccaaggguccggcuacgccgcugauaaggagagcacacagaaggccuuugacggaaucaccaauaaagucaacucugugauugaaaagaugaauacccaguucgaggcgguuggcaaagaauuuuccaaccuggagcgcagacucgaaaaucugaacaagaaaauggaggacggguuccuugauguguggacauauaaugccgagcugcucguccugauggaaaacgagcggacccuugacuuccacgauagcaaugugaagaaccuguacgacaagguucgcaugcagcucagagauaacgugaaagaacugggaaauggcuguuuugaguucuaucauaagugcgacgaugaguguaugaacucugucaaaaaugggacauacgacuacccuaaguaugaagaggaaagcaaacugaaccggaaugagaucaagggagugaagcucuccucuaugggcgucuaccaaauucuggcuaucuaugccacgguggcugggagccuuucccuggccauuaugauggccggcaucagcuuuuggaugugcucuaacggaucccuccagugcagaaucuguauuuga

SEQ ID NO: 186308 - RNA, 1689 nt, Artificial Sequence
  derived and/or modified sequence opt5 from hemagglutinin__InfluenzaA__ACV49611
auggccaucauuuaccugauccuccuguucaccgcugugagaggcgaccagauuugcaucggguaucacgccaacaauagcacagagaaggucgauacgauucuugaacggaacguuaccgugacacaugcgaaagacauccuggagaagacccacaauggaaaacucuguaagcugaacggcauucccccucuugaacugggggauugcuccaucgcuggauggcuccugggcaauccggagugugaccgccugcucucugugcccgaauggagcuacaucauggagaaagagaacccuagagaugggcugugcuaucccggauccuuuaaugacuacgaagaacuuaagcaucugcucucuagcgucaagcacuucgaaaaagugaagauucugccuaaagaucgguggacacaacauaccacaaccggcggcucccgcgccugugccguuucugggaaccccagcuuuuucagaaauaugguguggcuuacggagaagggauccaacuauccugucgcuaaaggcagcuacaauaacaccucuggggagcagaugcugaucauuuggggagugcaccacccgaaugacgaaacagagcagcggacccucuaucagaacguuggcacauacguguccgucgggaccagcacgcugaauaagcgcucuacacccaagaucgccaccagaccuaaagugaacggacaaggcggccggauggaauuuuccuggacacugcucgauaugugggacaccauuaacuucgagagcaccgggaaucugaucgcucccgaauacggauuuaagaucucuaaacgcggcuccagcgggauuaugaagacagagggaacgcuugagaacugcgaaaccaaaugucagacaccucugggcgccaucaauaccacacuccccuuccauaacgugcacccgcugaccauuggggagugcccuaaguaugucaaauccgaaaaacuuguucuggcgacgggacucagaaaugugccccagaucgagucucggggccuguuuggcgccauugcuggguucaucgaaggaggcuggcaggggaugguggauggaugguacggcuaucaucacagcaacgaccaaggguccggcuacgccgcugauaaggagagcacacagaaggccuuugacggaaucaccaauaaggucaacucugugauugagaaaaugaauacccaguucgaagcgguuggcaaggaguuuuccaaccuggaacgcagacucgagaaucugaacaaaaagguggaagacggguuccuugaugucuggacauauaaugccgagcugcucgugcugauggagaacgaacggacccuugacuuccacgauagcaauguuaagaaccuguacgacaaagugcgcaugcagcucagagauaacgucaaggagcugggaaauggcuguuuugaguucuaucauaaaugcgacgaugaguguaugaacucugugaagaaugggacauacgacuacccuaaauaugaggaagagagcaagcugaaccggaaugaaaucaagggagucaaacucuccucuaugggcguguaccaaauucuggcuaucuaugccacgguugcugggagccuuucccuggccauuaugauggccggcaucagcuuuuggaugugcucuaacggaucccuccagugcagaaucuguauuuga

SEQ ID NO: 186309 - RNA, 1701 nt, Artificial Sequence
  derived and/or modified sequence opt5 from hemagglutinin__InfluenzaA__ACV49633
augaagaccaucauugcccugagcuacauccucugccugguguucgcucagaaacuucccggcaacgacaauuccacagccacgcugugucucgggcaccaugcggucccuaacggaacccugguuaagacaauuaccaaugaucaaaucgaggugacaaacgcuaccgaacuugugcagucuagcuccacaggcagaauuugcgacucuccgcaccggauccuggaugggaaaaauuguacccucaucgacgcccugcugggagauccccauugcgacggcuuucagaacaaggagugggaucucuucgucgaacgcagcaaagccuauuccaauuguuacccuuaugacgugcccgauuacgcuucucugagaagccuuguugccuccagcgggacgcuggaguuuaccaacgaaggauucaauuggacaggcguggcucaggacggcaccucuuaugccugcaagcggggguccgucaagagcuuuuucucucgccucaacuggcugcacaaacuugaguacaaguauccugcgcugaaugugacaaugcccaacaaugauaaauuugacaagcucuacauuuggggaguucaucacccuuccaccgauagcgugcaaacgucucuguacguccaggccuccggcagagugacagugagcaccaaacggucccagcagacagucaucccgaacauugggucucgccccuggguuagaggaaucagcucccggauuagcaucuauuggaccauugugaagccuggcgacauccugcucaucaauucuaccgggaaccugauugcuccccgcggauacuucaagaucagauccggcaaaagcucuauuaugcggagcgacgccccuaucggcaacuguaauuccgagugcauuacacccaacgggucuaucccgaaugauaagccuuuucaaaacgugaaucgcaucacguauggagcuugucccagauacgucaaacagaacacccuuaagcuggccacaggcaugcggaaugugccugaaaaacagacccgcgggauuuucggagcgaucgccggcuuuauugagaacgggugggaaggaaugguugacggcugguauggcuucagacaccagaauagcgaggggacaggacaagcugccgaucucaaguccacccaggcugccaucaaccagauuaauggcaaacugaaccggcuuaucgagaagacgaaugaaaaguuuccccaaaucgagaaagaguucagcgaaguggaagggcgcauucaggaccuggagaaguacgucgaggauacaaaaaucgaccucuggucuuauaacgccgaacugcugguggcucucgagaaucagcauaccauugaucugaccgacuccgaaaugaacaaacuuuucgagagaacacggaagcagcugagagaaaacgcggaggauaugggaaauggcugcuuuaagaucuaccacaagugugacaacgccugcauugggagcauccgcaauggcaccuacgaucaugacguuuaucgggacgaggcucucaacaauagauuccaaauuaaaggaguggaacugaagucuggcuacaaagauuggauccuuuggaucuccuuugccauuagcugcuuccugcucugugucgugcugcugggguuuaucaugugggccugccagaagggaaacauucgcuguaauaucugcauuuga

SEQ ID NO: 186310 - RNA, 1701 nt, Artificial Sequence; identical to SEQ ID NO: 185380
  derived and/or modified sequence opt5 from hemagglutinin__InfluenzaA__ACV49644

SEQ ID NO: 186311 - RNA, 1698 nt, Artificial Sequence; identical to SEQ ID NO: 186199
  derived and/or modified sequence opt5 from hemagglutinin__InfluenzaA__ACV49676

SEQ ID NO: 186312 - RNA, 1701 nt, Artificial Sequence; identical to SEQ ID NO: 185680
  derived and/or modified sequence opt5 from hemagglutinin__InfluenzaA__ACV53450

SEQ ID NO: 186313 - RNA, 1701 nt, Artificial Sequence; identical to SEQ ID NO: 185680
  derived and/or modified sequence opt5 from hemagglutinin__InfluenzaA__ACV53460

SEQ ID NO: 186314 - RNA, 1701 nt, Artificial Sequence; identical to SEQ ID NO: 185680
  derived and/or modified sequence opt5 from hemagglutinin__InfluenzaA__ACV53480

SEQ ID NO: 186315 - RNA, 1701 nt, Artificial Sequence
  derived and/or modified sequence opt5 from hemagglutinin__InfluenzaA__ACV53490
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcgacaucgccggguggauucugggaaacccugaaugugagucucucagcacagcuuccucuuggagcuacaucguggaaaccuccucuagcgauaauggcacgugcuauccgggggacuuuauugauuacgaggagcugcgggaacagcuuuccagcgucucuuccuucgagcgcuuugaaaucuuccccaaaaccagcucuuggccuaaccacgacuccaauaagggagugacagccgcuuguccccaugccggcgccaagagcuuuuauaaaaaccugaucuggcucguuaagaaaggcaauucuuacccuaagcuguccaaaagcuauauuaacgauaaggggaaggaggugcuuguccuguggggaauccaccaccccuccaccucugccgaccaacagagccucuaccagaaugcugaugccuacguguucgugggcuccagcagauauucuaaaaaguuuaaaccugagauugcuauccggccgaagguccgcgaccaggaagggagaaugaacuacuauuggacacugguugagcccggagauaaaauuaccuucgaagccacgggcaaucugguggugccucgguacgcguuugccauggagcgcaacgcuggguccggaaucauuaucagcgacacacccguccaugacugcaacaccacaugucaaaccccuaagggcgccaucaauaccucucuccccuuccacaacauucauccgaucacaauuggcaaaugcccuaaguauguuaagagcacgaaacugagacuugcuaccgggcugcggaaugugcccuccauccagucucgcggacucuuuggcgccauugccggguucaucgaaggaggcuggacagggaugguggauggaugguacggcuaucaccaccagaacgagcagggcagcggguacgcugcggaccugaaguccacccaaaaugccaucgaugagauuacaaacaaagucaauagcgugaucgaaaagaugaacacccaguuuacggcuguuggaaaagaguucaaucaucuugaaacaagaauugagaaccugaauaagaagguggacgauggcuuccucgacaucuggaccuacaacgccgaacugcugguccuccuggagaaugagcggacccuugauuaucacgacucuaacgugaaaaaucuguacgaaaagguccgcucccagcucaaaaacaacgccaaggagauugggaauggauguuuugaguucuaucauaaaugcgauaacacauguauggaaagcgugaagaauggcaccuacgacuauccuaaguacucugaagaggcuaaacugaacagagaggaaaucgaugggguuaaacuugaguccacacggaucuaucagauucuggccaucuacagcacgguggcguccucucucguccuggugguuagccugggcgcuauuuccuuuuggaugugcucuaauggaagccuccaaugccgcaucuguauuuga

SEQ ID NO: 186316 - RNA, 1701 nt, Artificial Sequence
  derived and/or modified sequence opt5 from hemagglutinin__InfluenzaA__ACV53500
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaagcacaaugggaaacuuuguaagcugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccucugccgaucaacagagccucuaccagaacgcugacgccuacguguucgugggcuccagcagauauucuaaaaaguuuaaaccugagauugcuauccggccgaagguccgcgaucaggaagggagaaugaauuacuauuggacacugguugagcccggagacaaaauuaccuucgaagccacgggcaaccugguggugccucgguacgcguuugccauggagcgcaacgcuggguccggaaucauuaucagcgauacacccguccaugacugcaauaccacaugucaaaccccuaagggcgccaucaacaccucucuccccuuccacaauauucauccgaucacaauuggcaaaugcccuaaguauguuaagagcacgaaacugagacuugcuaccgggcugcggaacgugcccuccauccagucucgcggacucuuuggcgccauugccggguucaucgaaggaggcuggacagggaugguggacggaugguacggcuaucaccaccagaaugagcagggcagcggguacgcugcggaucugaaguccacccaaaacgccaucgacgagauuacaaauaaagucaacagcgugaucgaaaagaugaauacccaguuuacggcuguuggaaaagaguucaaccaucuugaaacaagaauugagaaucugaacaagaagguggaugacggcuuccucgauaucuggaccuacaaugccgaacugcugguccuccuggagaacgagcggacccuugacuaucacgauucuaaugugaaaaaccuguacgaaaagguccgcucccagcucaaaaacaaugccaaggagauugggaacggauguuuugaguucuaucauaaaugcgacaauacauguauggaaagcgugaagaacggcaccuacgauuauccuaaguacucugaagaggcuaaacugaauagagaggaaaucgacgggguuaaacuugaguccacacggaucuaucagauucuggccaucuacagcacgguggcguccucucucguccuggugguuagccugggcgcuauuuccuuuuggaugugcucuaacggaagccuccaaugccgcaucuguauuuga

SEQ ID NO: 186317 - RNA, 1701 nt, Artificial Sequence
  derived and/or modified sequence opt5 from hemagglutinin__InfluenzaA__ACV53880
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacaaccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 186318 - RNA, 1701 nt, Artificial Sequence; identical to SEQ ID NO: 185693
  derived and/or modified sequence opt5 from hemagglutinin__InfluenzaA__ACV53881

SEQ ID NO: 186319 - RNA, 1701 nt, Artificial Sequence; identical to SEQ ID NO: 185680
  derived and/or modified sequence opt5 from hemagglutinin__InfluenzaA__ACV53882

SEQ ID NO: 186320 - RNA, 1701 nt, Artificial Sequence; identical to SEQ ID NO: 185693
  derived and/or modified sequence opt5 from hemagglutinin__InfluenzaA__ACV53883

SEQ ID NO: 186321 - RNA, 1701 nt, Artificial Sequence; identical to SEQ ID NO: 185693
  derived and/or modified sequence opt5 from hemagglutinin__InfluenzaA__ACV53885

SEQ ID NO: 186322 - RNA, 1701 nt, Artificial Sequence
  derived and/or modified sequence opt5 from hemagglutinin__InfluenzaA__ACV53899
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccugagggcgccaucaacacaagccuccccuuccagaauauucacccgaucacgauuggcaaaugcccuaaguaugugaagucuaccaaacugagacuugcuacagggcugcggaacguucccagcauccagucccgcggacucuuuggcgccauugccggguucaucgaaggaggcuggaccgggaugguggacggaugguacggcuaucaucaccagaaugagcaaggcucuggguacgcugcggaucuuaagagcacacagaacgccaucgacgagauuaccaauaaagucaacuccgugaucgaaaagaugaauacgcaguuuacagcuguuggaaaagaguucaaccaccuggaaaagagaauugagaaucugaacaagaaaguggaugacggcuuccucgauaucuggaccuacaaugccgaacugcugguccuccuggagaacgagcggacccuugacuaucaugauagcaaugugaagaaccuguacgaaaaaguccgcucucagcucaagaacaaugccaaagagauugggaacggauguuuugaguucuaucacaagugcgacaauacauguauggaguccgugaagaacggcaccuacgauuauccuaaauacagcgaagaggcuaagcugaauagagaggaaaucgacgggguuaaacuugagucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186323 - RNA, 1701 nt, Artificial Sequence; identical to SEQ ID NO: 185693
  derived and/or modified sequence opt5 from hemagglutinin__InfluenzaA__ACV53909

SEQ ID NO: 186324 - RNA, 1701 nt, Artificial Sequence; identical to SEQ ID NO: 185693
  derived and/or modified sequence opt5 from hemagglutinin__InfluenzaA__ACV67220

SEQ ID NO: 186325 - RNA, 1701 nt, Artificial Sequence
  derived and/or modified sequence opt5 from hemagglutinin__InfluenzaA__ACV67221
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugaguguggcucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccaacaagggcgugacagccgcuuguccccaugccggcgcgaaaucuuuuuauaagaaucugaucuggcucguuaaaaaggggaacagcuacccuaaacuguccaagagcuauauuaaugacaagggaaaagaggugcuuguccuguggggcauccaccaccccuccaccucugccgaucaacagagccucuaccaguccgcugacgccuacguguucguggggacaagcagauauucuaagaaauuuaagccugaaauugcuauccggccgaaaguccgcgaucaggagggaagaaugaacuacuauuggacccugguugagcccggcgacaagauuacguucgaagccacagggaaucugguggugccucgguacgcguuugccauggagcgcaacgcuggauccggcaucauuaucagcgauacccccguccaugacugcaacacaaccugucaaaccccuaaaggcgccaucaauacaucucuccccuuccagaacauucacccgaucacgauugggaagugcccuaaguaugugaaaagcaccaagcugagacuugcuacaggacugcggaauguucccuccauccagucucgcggccucuuuggggccauugccggauucaucgaaggcggguggaccggaaugguggacggcugguacggcuaucaucaccagaacgagcaagggagcggauacgcugcggaucugaaauccacacagaaugccaucgacgaaauuaccaacaaggucaauagcgugaucgagaaaaugaacacgcaguuuacagcuguuggcaaggaguucaaucaccuugaaaagagaauugagaaccugaauaaaaagguggaugacggguuccucgauaucuggaccuacaacgccgaacugcugguccuccuggagaaugaacggacccuugacuaucaugauucuaacgugaaaaaucuguacgagaagguccgcucccagcucaaaaacaacgccaaggagauuggaaauggcuguuuugaguucuaucacaagugcgacaacacauguauggaaagcgugaaaaaugggaccuacgauuauccuaaguacucugaagaggcuaaacugaacagagaagagaucgacggcguuaaacuugaguccacacggaucuaucaaauucuggccaucuacagcacgguggcguccucucucguccuggugguuagccugggagcuauuuccuuuuggaugugcucuaauggcagccuccagugccgcaucuguauuuga

SEQ ID NO: 186326 - RNA, 1701 nt, Artificial Sequence; identical to SEQ ID NO: 185680
  derived and/or modified sequence opt5 from hemagglutinin__InfluenzaA__ACV67222

SEQ ID NO: 186327 - RNA, 1701 nt, Artificial Sequence; identical to SEQ ID NO: 185719
  derived and/or modified sequence opt5 from hemagglutinin__InfluenzaA__ACV67223

SEQ ID NO: 186328 - RNA, 1701 nt, Artificial Sequence; identical to SEQ ID NO: 185935
  derived and/or modified sequence opt5 from hemagglutinin__InfluenzaA__ACV67224

SEQ ID NO: 186329 - RNA, 1701 nt, Artificial Sequence; identical to SEQ ID NO: 185873
  derived and/or modified sequence opt5 from hemagglutinin__InfluenzaA__ACV67225

SEQ ID NO: 186330 - RNA, 1701 nt, Artificial Sequence; identical to SEQ ID NO: 185693
  derived and/or modified sequence opt5 from hemagglutinin__InfluenzaA__ACV67226

SEQ ID NO: 186331 - RNA, 1701 nt, Artificial Sequence
  derived and/or modified sequence opt5 from hemagglutinin__InfluenzaA__ACV67227
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccaauacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186332 - RNA, 1701 nt, Artificial Sequence; identical to SEQ ID NO: 185935
  derived and/or modified sequence opt5 from hemagglutinin__InfluenzaA__ACV67228

SEQ ID NO: 186333 - RNA, 1701 nt, Artificial Sequence
  derived and/or modified sequence opt5 from hemagglutinin__InfluenzaA__ACV67229
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacccuaucgacgagauuaccaauaaggucaacuccgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuaucccaaguacagcgaggaagccaaacugaauagagaggagaucgacgggguuaaacuugaaucuacacggaucuaucaaauucuggcuaucuacuccacgguggccagcucccucguccuggugguuucucugggcgcgauuagcuuuuggaugugcuccaacggaucucuccagugccgcaucuguauuuga

SEQ ID NO: 186334 - RNA, 1701 nt, Artificial Sequence; identical to SEQ ID NO: 185680
  derived and/or modified sequence opt5 from hemagglutinin__InfluenzaA__ACV67230

SEQ ID NO: 186335 - RNA, 1701 nt, Artificial Sequence; identical to SEQ ID NO: 185693
  derived and/or modified sequence opt5 from hemagglutinin__InfluenzaA__ACV67231

SEQ ID NO: 186336 - RNA, 1701 nt, Artificial Sequence; identical to SEQ ID NO: 185693
  derived and/or modified sequence opt5 from hemagglutinin__InfluenzaA__ACV67232

SEQ ID NO: 186337 - RNA, 1701 nt, Artificial Sequence; identical to SEQ ID NO: 185680
  derived and/or modified sequence opt5 from hemagglutinin__InfluenzaA__ACV67233

SEQ ID NO: 186338 - RNA, 1701 nt, Artificial Sequence; identical to SEQ ID NO: 185935
  derived and/or modified sequence opt5 from hemagglutinin__InfluenzaA__ACV67234

SEQ ID NO: 186339 - RNA, 1701 nt, Artificial Sequence
  derived and/or modified sequence opt5 from hemagglutinin__InfluenzaA__ACV67235
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaacgaaauugggaauggauguuuugaguucuaucacaagugcgacaacaccuguauggaaagcgugaagaauggcacauacgauuauccuaaauacucugaggaagcuaagcugaacagagaggagaucgacgggguuaaacuugaauccacccggaucuaucaaauucuggccaucuacagcacaguggcguccucucucguccuggugguuagccugggcgcuauuuccuuuuggaugugcucuaauggaagccuccagugccgcaucuguauuuga

SEQ ID NO: 186340 - RNA, 1701 nt, Artificial Sequence; identical to SEQ ID NO: 185937
  derived and/or modified sequence opt5 from hemagglutinin__InfluenzaA__ACV67236

SEQ ID NO: 186341 - RNA, 1701 nt, Artificial Sequence; identical to SEQ ID NO: 185680
  derived and/or modified sequence opt5 from hemagglutinin__InfluenzaA__ACV67238

SEQ ID NO: 186342 - RNA, 1701 nt, Artificial Sequence
  derived and/or modified sequence opt5 from hemagglutinin__InfluenzaA__ACV67239
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcuccagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcaauaacacauguauggaaagcgugaaaaauggcaccuacgacuauccuaaguacucugaggaagccaaacugaacagagaggagaucgaugggguuaaacuugaauccacacggaucuaucaaauucuggcuaucuacagcacgguggccuccucucucguccuggugguuagccugggcgcgauuuccuuuuggaugugcucuaauggaagccuccagugccgcaucuguauuuga

SEQ ID NO: 186343 - RNA, 1701 nt, Artificial Sequence; identical to SEQ ID NO: 185937
  derived and/or modified sequence opt5 from hemagglutinin__InfluenzaA__ACV67240

SEQ ID NO: 186344 - RNA, 1701 nt, Artificial Sequence
  derived and/or modified sequence opt5 from hemagglutinin__InfluenzaA__ACV67241
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaacggcaauagcuacccuaagcuguccaaaagcuauauuaacgacaaggggaaggaagugcuuguccuguggggaauccaccaccccuccaccucugccgaucaacagagccucuaccagaaugcugacgccuacguguucgugggcacauccagauauagcaaaaaguuuaaaccugagauugcuauccggccgaagguccgcgaucaggaggggagaaugaacuacuauuggacccugguugaacccggagacaaaauuacguucgaggccacaggcaaccugguggugccucgguacgcguuugccauggaacgcaaugcugggucuggaaucauuaucuccgauacccccguccaugacugcaacacaaccugucaaaccccuaagggcgccaucaauacaagccuccccuuccagaacauucacccgaucacgauuggcaaaugcccuaaguaugugaagucuaccaaacugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaucuuaagagcacacagaaugccaucgacgagauuaccaacaaagucaauuccgugaucgagaagaugaacacgcaguuuacagcuguuggaaaagaguucaaucaccuggagaagagaauugaaaaccugaauaagaaaguggaugacggcuuccucgauaucuggaccuacaacgccgagcugcugguccuccuggaaaaugagcggacccuugacuaucaugauagcaacgugaagaaccuguacgagaaaguccgcucucagcucaagaauaacgccaaagaaauugggaauggauguuuugaguucuaucacaagugcgacaacacauguauggaauccgugaagaauggcaccuacgauuauccuaaauacagcgaggaagcuaagcugaacagagaggagaucgacgggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186345 - RNA, 1701 nt, Artificial Sequence; identical to SEQ ID NO: 185935
  derived and/or modified sequence opt5 from hemagglutinin__InfluenzaA__ACV67242

SEQ ID NO: 186346 - RNA, 1701 nt, Artificial Sequence; identical to SEQ ID NO: 185873
  derived and/or modified sequence opt5 from hemagglutinin__InfluenzaA__ACV67244

SEQ ID NO: 186347 - RNA, 1701 nt, Artificial Sequence; identical to SEQ ID NO: 185786
  derived and/or modified sequence opt5 from hemagglutinin__InfluenzaA__ACV67246

SEQ ID NO: 186348 - RNA, 1701 nt, Artificial Sequence; identical to SEQ ID NO: 186317
  derived and/or modified sequence opt5 from hemagglutinin__InfluenzaA__ACV67247

SEQ ID NO: 186349 - RNA, 1701 nt, Artificial Sequence; identical to SEQ ID NO: 185680
  derived and/or modified sequence opt5 from hemagglutinin__InfluenzaA__ACV70073

SEQ ID NO: 186350 - RNA, 1701 nt, Artificial Sequence; identical to SEQ ID NO: 185680
  derived and/or modified sequence opt5 from hemagglutinin__InfluenzaA__ACV70093

SEQ ID NO: 186351 - RNA, 1701 nt, Artificial Sequence; identical to SEQ ID NO: 185680
  derived and/or modified sequence opt5 from hemagglutinin__InfluenzaA__ACV70103

SEQ ID NO: 186352 - RNA, 1701 nt, Artificial Sequence; identical to SEQ ID NO: 185680
  derived and/or modified sequence opt5 from hemagglutinin__InfluenzaA__ACV70113

SEQ ID NO: 186353 - RNA, 1701 nt, Artificial Sequence; identical to SEQ ID NO: 185680
  derived and/or modified sequence opt5 from hemagglutinin__InfluenzaA__ACV70123

SEQ ID NO: 186354 - RNA, 1701 nt, Artificial Sequence; identical to SEQ ID NO: 185680
  derived and/or modified sequence opt5 from hemagglutinin__InfluenzaA__ACV70154

SEQ ID NO: 186355 - RNA, 1701 nt, Artificial Sequence
  derived and/or modified sequence opt5 from hemagglutinin__InfluenzaA__ACV70164
augaaggccauccuggugguccuccuguacaccuucacaacggcuaacgccgacacccuuugcauuggcuaucacgcgaauaacagcacagauaccguugacacagugcuggagaaaaaugugaccgucacacauuccgugaaccuccuggaagauaagcacaaugggaaacuuuguaagcugagaggaguugcuccccuccaucugggcaaaugcaacaucgccggguggauucugggaaauccugagugugaaucucucagcaccgccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgcugccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcuccagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaacccucaaaggcgcuaucaacacaucucugccuuuccagaauauucaccccaucacgauuggcaagugcccgaaguaugugaaaagcaccaaacuuagacuggccacagggcuccggaacguuccuuccauccagucucgcggacuguuuggcgcuauugccggguucaucgagggaggcuggaccgggaugguggacggaugguacggcuaucaucaccagaaugaacaaggcagcggguacgccgcugaucuuaaauccacacagaacgcgaucgacgagauuaccaauaaggucaacagcgugaucgagaaaaugaauacgcaguuuacagccguuggaaaggaguucaaccaccuggagaagagaauugaaaaucucaacaaaaagguggaugacggcuuccuggauaucuggaccuacaaugcugagcugcucguccugcuugaaaacgagcggacccuggacuaucaugauucuaaugugaaaaaccucuacgagaagguccgcucccagcugaaaaacaaugccaaggaaauugggaacggauguuuugaguucuaucacaagugcgacaauacauguauggaaagcgugaaaaacggcaccuacgauuaucccaaguacucugaggaagccaaacuuaauagagaggagaucgacgggguuaagcuggaauccacacggaucuaucaaauucucgcuaucuacagcacgguggccuccucucugguccuggugguuagccucggcgcgauuuccuuuuggaugugcucuaacggaagccugcagugccgcaucuguauuuga

SEQ ID NO: 186356 - RNA, 1701 nt, Artificial Sequence; identical to SEQ ID NO: 185680
  derived and/or modified sequence opt5 from hemagglutinin__InfluenzaA__ACV70174

SEQ ID NO: 186357 - RNA, 1701 nt, Artificial Sequence; identical to SEQ ID NO: 185680
  derived and/or modified sequence opt5 from hemagglutinin__InfluenzaA__ACV70184

SEQ ID NO: 186358 - RNA, 1701 nt, Artificial Sequence; identical to SEQ ID NO: 185680
  derived and/or modified sequence opt5 from hemagglutinin__InfluenzaA__ACV70194

SEQ ID NO: 186359 - RNA, 1701 nt, Artificial Sequence; identical to SEQ ID NO: 185680
  derived and/or modified sequence opt5 from hemagglutinin__InfluenzaA__ACV70204

SEQ ID NO: 186360 - RNA, 1701 nt, Artificial Sequence; identical to SEQ ID NO: 185680
  derived and/or modified sequence opt5 from hemagglutinin__InfluenzaA__ACV70214

SEQ ID NO: 186361 - RNA, 1701 nt, Artificial Sequence; identical to SEQ ID NO: 185680
  derived and/or modified sequence opt5 from hemagglutinin__InfluenzaA__ACV70224

SEQ ID NO: 186362 - RNA, 1701 nt, Artificial Sequence; identical to SEQ ID NO: 185680
  derived and/or modified sequence opt5 from hemagglutinin__InfluenzaA__ACV70234

SEQ ID NO: 186363 - RNA, 1701 nt, Artificial Sequence; identical to SEQ ID NO: 185680
  derived and/or modified sequence opt5 from hemagglutinin__InfluenzaA__ACV70254

SEQ ID NO: 186364 - RNA, 1701 nt, Artificial Sequence; identical to SEQ ID NO: 185680
  derived and/or modified sequence opt5 from hemagglutinin__InfluenzaA__ACV70264

SEQ ID NO: 186365 - RNA, 1701 nt, Artificial Sequence; identical to SEQ ID NO: 185680
  derived and/or modified sequence opt5 from hemagglutinin__InfluenzaA__ACV70274

SEQ ID NO: 186366 - RNA, 1701 nt, Artificial Sequence; identical to SEQ ID NO: 185680
  derived and/or modified sequence opt5 from hemagglutinin__InfluenzaA__ACV70284

SEQ ID NO: 186367 - RNA, 1701 nt, Artificial Sequence; identical to SEQ ID NO: 185680
  derived and/or modified sequence opt5 from hemagglutinin__InfluenzaA__ACV70294

SEQ ID NO: 186368 - RNA, 1701 nt, Artificial Sequence; identical to SEQ ID NO: 185680
  derived and/or modified sequence opt5 from hemagglutinin__InfluenzaA__ACV70304

SEQ ID NO: 186369 - RNA, 1701 nt, Artificial Sequence; identical to SEQ ID NO: 186355
  derived and/or modified sequence opt5 from hemagglutinin__InfluenzaA__ACV70314

SEQ ID NO: 186370 - RNA, 1701 nt, Artificial Sequence
  derived and/or modified sequence opt5 from hemagglutinin__InfluenzaA__ACV70324
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucuuuacagccagcuccuggucuuacaucguggagaccagcuccucugacaacggcacgugcuauccgggggauuucauugacuacgaagaacugcgggagcagcuuagcuccgucagcucuuuugaacgcuucgagaucuuucccaagaccuccagcuggccuaaucacgauucuaacaagggagugacagccgcuuguccccaugccggcgcgaaauccuucuauaagaaucugaucuggcucguuaaaaagggcaacagcuacccuaaacugucuaaguccuauauuaaugacaaggggaaagaagugcuuguccuguggggaauccaccaccccagcaccuccgccgaucaacagucucucuaccagaacgcugacgccuacguguuugugggcagcuccagauauagcaagaaauucaagccugagauugcuauccggccgaaaguccgcgaucaggaggggagaaugaauuacuauuggacacugguugaacccggagacaagauuaccuuugaggccacgggcaaccugguggugccucgguacgcguucgccauggaacgcaacgcugggucuggaaucauuaucuccgauacacccguccaugacugcaauaccacaugucaaaccccuaaaggcgccaucaacaccagccuccccuuucagaauauucacccgaucacaauuggcaagugcccuaaguaugugaaaucuacgaagcugagacuugcuaccgggcugcggaacguucccagcauccagucccgcggacucuucggcgccauugccggguuuaucgagggaggcuggacagggaugguggacggaugguacggcuaucaucaccagaaugaacaaggcucuggguacgcugcggaucugaaaagcacccagaacgccaucgacgagauuacaaauaaggucaacuccgugaucgagaaaaugaauacccaguucacggcuguuggaaaggaguucaaccaccuugagaagagaauugaaaaucugaacaaaaagguggaugacggcuuucucgauaucuggacauacaaugccgagcugcugguccuccuggaaaacgagcggacccuugacuaucaugauagcaaugugaaaaaccuguacgagaagguccgcucucagcucaaaaacaaugccaaggaaauugggaacggauguuucgaguuuuaucacaagugcgacaauaccuguauggaauccgugaaaaacggcacauacgauuauccuaaguacagcgaggaagcuaaacugaauagagaggagaucgacgggguuaaacuugaaucuacccggaucuaucaaauucuggccaucuacuccacaguggcgagcucccucguccuggugguuucucugggcgcuauuagcuucuggaugugcuccaacggaucucuccagugccgcaucuguauuuga

SEQ ID NO: 186371 - RNA, 1701 nt, Artificial Sequence; identical to SEQ ID NO: 185680
  derived and/or modified sequence opt5 from hemagglutinin__InfluenzaA__ACV70334

SEQ ID NO: 186372 - RNA, 1701 nt, Artificial Sequence; identical to SEQ ID NO: 185680
  derived and/or modified sequence opt5 from hemagglutinin__InfluenzaA__ACV70344

SEQ ID NO: 186373 - RNA, 1701 nt, Artificial Sequence; identical to SEQ ID NO: 185680
  derived and/or modified sequence opt5 from hemagglutinin__InfluenzaA__ACV70354

SEQ ID NO: 186374 - RNA, 1701 nt, Artificial Sequence; identical to SEQ ID NO: 185680
  derived and/or modified sequence opt5 from hemagglutinin__InfluenzaA__ACV70364

SEQ ID NO: 186375 - RNA, 1701 nt, Artificial Sequence; identical to SEQ ID NO: 185680
  derived and/or modified sequence opt5 from hemagglutinin__InfluenzaA__ACV70374

SEQ ID NO: 186376 - RNA, 1701 nt, Artificial Sequence; identical to SEQ ID NO: 185680
  derived and/or modified sequence opt5 from hemagglutinin__InfluenzaA__ACV70384

SEQ ID NO: 186377 - RNA, 1701 nt, Artificial Sequence; identical to SEQ ID NO: 185680
  derived and/or modified sequence opt5 from hemagglutinin__InfluenzaA__ACV70394

SEQ ID NO: 186378 - RNA, 1701 nt, Artificial Sequence; identical to SEQ ID NO: 185680
  derived and/or modified sequence opt5 from hemagglutinin__InfluenzaA__ACV70404

SEQ ID NO: 186379 - RNA, 1701 nt, Artificial Sequence; identical to SEQ ID NO: 186355
  derived and/or modified sequence opt5 from hemagglutinin__InfluenzaA__ACV70414

SEQ ID NO: 186380 - RNA, 1701 nt, Artificial Sequence; identical to SEQ ID NO: 185680
  derived and/or modified sequence opt5 from hemagglutinin__InfluenzaA__ACV70424

SEQ ID NO: 186381 - RNA, 1701 nt, Artificial Sequence; identical to SEQ ID NO: 185680
  derived and/or modified sequence opt5 from hemagglutinin__InfluenzaA__ACV70434

SEQ ID NO: 186382 - RNA, 1701 nt, Artificial Sequence; identical to SEQ ID NO: 185680
  derived and/or modified sequence opt5 from hemagglutinin__InfluenzaA__ACV70444

SEQ ID NO: 186383 - RNA, 1701 nt, Artificial Sequence; identical to SEQ ID NO: 185680
  derived and/or modified sequence opt5 from hemagglutinin__InfluenzaA__ACV70454

SEQ ID NO: 186384 - RNA, 1701 nt, Artificial Sequence; identical to SEQ ID NO: 185680
  derived and/or modified sequence opt5 from hemagglutinin__InfluenzaA__ACV70464

SEQ ID NO: 186385 - RNA, 1701 nt, Artificial Sequence; identical to SEQ ID NO: 185680
  derived and/or modified sequence opt5 from hemagglutinin__InfluenzaA__ACV70474

SEQ ID NO: 186386 - RNA, 1701 nt, Artificial Sequence; identical to SEQ ID NO: 185680
  derived and/or modified sequence opt5 from hemagglutinin__InfluenzaA__ACV70484

SEQ ID NO: 186387 - RNA, 1701 nt, Artificial Sequence; identical to SEQ ID NO: 185680
  derived and/or modified sequence opt5 from hemagglutinin__InfluenzaA__ACV70494

SEQ ID NO: 186388 - RNA, 1701 nt, Artificial Sequence; identical to SEQ ID NO: 185680
  derived and/or modified sequence opt5 from hemagglutinin__InfluenzaA__ACV70504

SEQ ID NO: 186389 - RNA, 1701 nt, Artificial Sequence; identical to SEQ ID NO: 185680
  derived and/or modified sequence opt5 from hemagglutinin__InfluenzaA__ACV70514

SEQ ID NO: 186390 - RNA, 1701 nt, Artificial Sequence; identical to SEQ ID NO: 185680
  derived and/or modified sequence opt5 from hemagglutinin__InfluenzaA__ACV70524

SEQ ID NO: 186391 - RNA, 1701 nt, Artificial Sequence; identical to SEQ ID NO: 185873
  derived and/or modified sequence opt5 from hemagglutinin__InfluenzaA__ACV70534

SEQ ID NO: 186392 - RNA, 1701 nt, Artificial Sequence; identical to SEQ ID NO: 185680
  derived and/or modified sequence opt5 from hemagglutinin__InfluenzaA__ACV70544

SEQ ID NO: 186393 - RNA, 1701 nt, Artificial Sequence; identical to SEQ ID NO: 185680
  derived and/or modified sequence opt5 from hemagglutinin__InfluenzaA__ACV70564

SEQ ID NO: 186394 - RNA, 1701 nt, Artificial Sequence; identical to SEQ ID NO: 185680
  derived and/or modified sequence opt5 from hemagglutinin__InfluenzaA__ACV70584

SEQ ID NO: 186395 - RNA, 1701 nt, Artificial Sequence; identical to SEQ ID NO: 186355
  derived and/or modified sequence opt5 from hemagglutinin__InfluenzaA__ACV70594

SEQ ID NO: 186396 - RNA, 1701 nt, Artificial Sequence; identical to SEQ ID NO: 185680
  derived and/or modified sequence opt5 from hemagglutinin__InfluenzaA__ACV70604

SEQ ID NO: 186397 - RNA, 1701 nt, Artificial Sequence; identical to SEQ ID NO: 185680
  derived and/or modified sequence opt5 from hemagglutinin__InfluenzaA__ACV70614

SEQ ID NO: 186398 - RNA, 1701 nt, Artificial Sequence; identical to SEQ ID NO: 185680
  derived and/or modified sequence opt5 from hemagglutinin__InfluenzaA__ACV70624

SEQ ID NO: 186399 - RNA, 1701 nt, Artificial Sequence; identical to SEQ ID NO: 185680
  derived and/or modified sequence opt5 from hemagglutinin__InfluenzaA__ACV70634

SEQ ID NO: 186400 - RNA, 1701 nt, Artificial Sequence; identical to SEQ ID NO: 185680
  derived and/or modified sequence opt5 from hemagglutinin__InfluenzaA__ACV70644

SEQ ID NO: 186401 - RNA, 1701 nt, Artificial Sequence; identical to SEQ ID NO: 185680
  derived and/or modified sequence opt5 from hemagglutinin__InfluenzaA__ACV70654

SEQ ID NO: 186402 - RNA, 1701 nt, Artificial Sequence; identical to SEQ ID NO: 185680
  derived and/or modified sequence opt5 from hemagglutinin__InfluenzaA__ACV70664

SEQ ID NO: 186403 - RNA, 1701 nt, Artificial Sequence; identical to SEQ ID NO: 185680
  derived and/or modified sequence opt5 from hemagglutinin__InfluenzaA__ACV70674

SEQ ID NO: 186404 - RNA, 1701 nt, Artificial Sequence; identical to SEQ ID NO: 185680
  derived and/or modified sequence opt5 from hemagglutinin__InfluenzaA__ACV70684

SEQ ID NO: 186405 - RNA, 1701 nt, Artificial Sequence; identical to SEQ ID NO: 185680
  derived and/or modified sequence opt5 from hemagglutinin__InfluenzaA__ACV70694

SEQ ID NO: 186406 - RNA, 1701 nt, Artificial Sequence; identical to SEQ ID NO: 185680
  derived and/or modified sequence opt5 from hemagglutinin__InfluenzaA__ACV70704

SEQ ID NO: 186407 - RNA, 1701 nt, Artificial Sequence; identical to SEQ ID NO: 185680
  derived and/or modified sequence opt5 from hemagglutinin__InfluenzaA__ACV70714

SEQ ID NO: 186408 - RNA, 1701 nt, Artificial Sequence; identical to SEQ ID NO: 185680
  derived and/or modified sequence opt5 from hemagglutinin__InfluenzaA__ACV70724

SEQ ID NO: 186409 - RNA, 1701 nt, Artificial Sequence; identical to SEQ ID NO: 186317
  derived and/or modified sequence opt5 from hemagglutinin__InfluenzaA__ACV70734

SEQ ID NO: 186410 - RNA, 1701 nt, Artificial Sequence; identical to SEQ ID NO: 185680
  derived and/or modified sequence opt5 from hemagglutinin__InfluenzaA__ACV70744

SEQ ID NO: 186411 - RNA, 1701 nt, Artificial Sequence; identical to SEQ ID NO: 185680
  derived and/or modified sequence opt5 from hemagglutinin__InfluenzaA__ACV70754

SEQ ID NO: 186412 - RNA, 1701 nt, Artificial Sequence; identical to SEQ ID NO: 185680
  derived and/or modified sequence opt5 from hemagglutinin__InfluenzaA__ACV70764

SEQ ID NO: 186413 - RNA, 1701 nt, Artificial Sequence; identical to SEQ ID NO: 185680
  derived and/or modified sequence opt5 from hemagglutinin__InfluenzaA__ACV70784

SEQ ID NO: 186414 - RNA, 1701 nt, Artificial Sequence
  derived and/or modified sequence opt5 from hemagglutinin__InfluenzaA__ACV70794
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagccacagcugccuguccccaugcgggcgccaaaggcuuuuauaagaaucugaucuggcucgugaaaaaggggaacagcuacccuaaacugucuaaguccuauauuaaugacaagggaaaagaaguucuugugcuguggggcauccaccaccccagcaccuccgcugaucaacagucucucuaccagaacgccgacgcuuacgucuucguggggagcuccagauauagcaagaaauuuaagccugagauugccauccggccgaaagugcgcgaucaggagggaagaaugaauuacuauuggacacuggucgaacccggcgacaagauuaccuucgaggcgacggggaaccugguugugccucgguacgccuuugcuauggaacgcaacgccggaucuggcaucauuaucuccgauacacccgugcaugacugcaauaccacaugucaaaccccuaaaggcgcuaucaacaccagccuccccuuccagaauauucacccgaucacaauugggaagugcccuaaguaugucaaaucuacgaagcugagacuugccaccggacugcggaacgugcccagcauccagucccgcggccucuuuggggccauugcuggauucaucgagggcggguggacaggaaugguugacggcugguacggcuaucaucaccagaaugaacaagggucuggauacgcggccgaucugaaaagcacccagaacgcuaucgacgagauuacaaauaaggugaacuccgucaucgagaaaaugaauacccaguuuacggccgugggcaaggaguucaaccaccuugagaagagaauugaaaaucugaacaaaaagguugaugacggguuccucgauaucuggacauacaaugccgagcugcuggugcuccuggaaaacgagcggacccuugacuaucaugauagcaaugucaaaaaccuguacgagaaggugcgcucucagcucaaaaacaaugcuaaggaaauuggaaacggcuguuuugaguucuaucacaagugcgacaauaccuguauggaauccgucaaaaacgggacauacgauuauccuaaguacagcgaggaagccaaacugaauagagaggagaucgacggcgugaaacuugaaucuacccggaucuaucaaauucuggcgaucuacuccacaguugcuagcucccucgugcuggucgugucucugggagccauuagcuuuuggaugugcuccaacggcucucuccagugccgcaucuguauuuga

SEQ ID NO: 186415 - RNA, 1701 nt, Artificial Sequence; identical to SEQ ID NO: 185680
  derived and/or modified sequence opt5 from hemagglutinin__InfluenzaA__ACV70804

SEQ ID NO: 186416 - RNA, 1701 nt, Artificial Sequence; identical to SEQ ID NO: 186355
  derived and/or modified sequence opt5 from hemagglutinin__InfluenzaA__ACV70824

SEQ ID NO: 186417 - RNA, 1701 nt, Artificial Sequence; identical to SEQ ID NO: 185680
  derived and/or modified sequence opt5 from hemagglutinin__InfluenzaA__ACV70834

SEQ ID NO: 186418 - RNA, 1701 nt, Artificial Sequence
  derived and/or modified sequence opt5 from hemagglutinin__InfluenzaA__ACV70844
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaggcuuuuauaagaaucugaucuggcucguuaaaaaggggaacagcuacccuaaacugucuaaguccuauauuaaugacaagggaaaagaagugcuuguccuguggggcauccaccaccccagcaccuccgccgaucaacagucucucuaccagaacgcugacgccuacguguucguggggagcuccagauauagcaagaaauuuaagccugagauugcuauccggccgaaaguccgcgaucaggagggaagaaugaauuacuauuggacacugguugaacccggcgacaagauuaccuucgaggccacggggaaccugcucgugccucgguacgcguuugccauggaacgcaacgcuggaucuggcaucauuaucuccgauacacccgugcaugacugcaauaccacaugucaaaccccuaaaggcgccaucaacaccagccugcccuuccagaauauucacccgaucacaauugggaagugcccuaaguaugucaaaucuacgaaacuuagacuggcuaccggacuccggaacgugcccagcauccagucccgcggccuguuuggggccauugccggauucaucgagggcggguggacaggaaugguugacggcugguacggcuaucaucaccagaaugaacaagggucuggauacgcugcggaucuuaagagcacccagaacgccaucgacgagauuacaaauaaggugaacuccgucaucgagaaaaugaauacccaguuuacggcugugggcaaggaguucaaccaccuggagaagagaauugaaaaucucaacaaaaagguugaugacggguuccuggauaucuggacauacaaugccgagcugcucgugcugcuugaaaacgagcggacccuggacuaucaugauagcaaugucaaaaaccucuacgagaaggugcgcucucagcugaaaaacaaugccaaggaaauuggaaacggcuguuuugaguucuaucacaagugcgacaauaccuguauggaauccgucaaaaacgggacauacgauuauccuaaguacagcgaggaagcuaaacuuaauagagaggagaucgacggcgugaagcuggaaucuacccggaucuaucaaauucucgccaucuacuccacaguugcgagcucccuggugcuggucgugucucucggagcuauuagcuuuuggaugugcuccaacggcucucugcagugccgcaucuguauuuga

SEQ ID NO: 186419 - RNA, 1701 nt, Artificial Sequence; identical to SEQ ID NO: 185680
  derived and/or modified sequence opt5 from hemagglutinin__InfluenzaA__ACV70854

SEQ ID NO: 186420 - RNA, 1701 nt, Artificial Sequence
  derived and/or modified sequence opt5 from hemagglutinin__InfluenzaA__ACV70864
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaccagcuacccuaaacuguccaagagcuauauuaacgacaaggggaaagaagugcuuguccuguggggaauccaccaccccuccacaucugccgaucaacagagccucuaccagaaugcugacgccuacguguucgugggcuccagcagauauucuaagaaauuuaagccugagauugcuauccggccgaaaguccgcgaucaggaggggagaaugaacuacuauuggacccugguugaacccggagacaagauuacguucgaggccacaggcaaucugguggugccucgguacgcguuugccauggaacgcaacgcuggguccggaaucauuaucagcgauacccccguccaugacugcaacacaaccugucaaaccccuaaaggcgccaucaauacaucucuccccuuccagaacauucacccgaucacgauuggcaagugcccuaaguaugugaaaagcaccaagcugagacuugcuacagggcugcggaauguucccuccauccagucucgcggacucuuuggcgccauugccggguucaucgagggaggcuggaccgggaugguggacggaugguacggcuaucaucaccagaacgaacaaggcagcggguacgcugcggaucugaaauccacacagaaugccaucgacgagauuaccaacaaggucaauagcgugaucgagaaaaugaacacgcaguuuacagcuguuggaaaggaguucaaucaccuugagaagagaauugaaaaccugaauaaaaagguggaugacggcuuccucgauaucuggaccuacaacgccgagcugcugguccuccuggaaaaugagcggacccuugacuaucaugauucuaacgugaaaaaucuguacgagaagguccgcucccagcucaaaaacaacgccaaggaaauugggaauggauguuuugaguucuaucacaagugcgacaacacauguauggaaagcgugaaaaauggcaccuacgauuauccuaaguacucugaggaagcuaaacugaacagagaggagaucgacgggguuaaacuugaauccacacggaucuaucaaauucuggccaucuacagcacgguggcguccucucucguccuggugguuagccugggcgcuauuuccuuuuggaugugcucuaauggaagccuccagugccgcaucuguauuuga

SEQ ID NO: 186421 - RNA, 1701 nt, Artificial Sequence; identical to SEQ ID NO: 185680
  derived and/or modified sequence opt5 from hemagglutinin__InfluenzaA__ACV70874

SEQ ID NO: 186422 - RNA, 1701 nt, Artificial Sequence; identical to SEQ ID NO: 185873
  derived and/or modified sequence opt5 from hemagglutinin__InfluenzaA__ACV70884

SEQ ID NO: 186423 - RNA, 1701 nt, Artificial Sequence
  derived and/or modified sequence opt5 from hemagglutinin__InfluenzaA__ACV70904
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacauccccuccauucagucucgcggacucuuuggcgccaucgccggguucaucgagggaggcuggacagggaugguugacggaugguacggcuaucaucaccagaaugaacaaggcagcggguacgcugcggaucugaaauccacccagaacgccauugacgagaucacaaauaaggugaacagcgucauugagaaaaugaauacccaguuuacggcugugggaaaggaguucaaccaccuugagaagagaaucgaaaaucugaacaaaaagguugaugacggcuuccucgauauuuggacauacaaugccgagcugcuggugcuccuggaaaacgagcggacccuugacuaucaugauucuaaugucaaaaaccuguacgagaaggugcgcucccagcucaaaaacaaugccaaggaaaucgggaacggauguuuugaguucuaucacaagugcgacaauaccuguauggaaagcgucaaaaacggcacauacgauuauccuaaguacucugaggaagcuaaacugaauagagaggagaucgacggggugaaacuugaauccacccggauuuaucaaauccuggccauuuacagcacaguugcguccucucucgugcuggucgugagccugggcgcuaucuccuuuuggaugugcucuaacggaagccuccagugccgcauuuguaucuga

SEQ ID NO: 186424 - RNA, 1701 nt, Artificial Sequence; identical to SEQ ID NO: 185680
  derived and/or modified sequence opt5 from hemagglutinin__InfluenzaA__ACV70914

SEQ ID NO: 186425 - RNA, 1701 nt, Artificial Sequence; identical to SEQ ID NO: 185680
  derived and/or modified sequence opt5 from hemagglutinin__InfluenzaA__ACV70924

SEQ ID NO: 186426 - RNA, 1701 nt, Artificial Sequence; identical to SEQ ID NO: 185680
  derived and/or modified sequence opt5 from hemagglutinin__InfluenzaA__ACV70934

SEQ ID NO: 186427 - RNA, 1701 nt, Artificial Sequence; identical to SEQ ID NO: 185680
  derived and/or modified sequence opt5 from hemagglutinin__InfluenzaA__ACV70944

SEQ ID NO: 186428 - RNA, 1701 nt, Artificial Sequence
  derived and/or modified sequence opt5 from hemagglutinin__InfluenzaA__ACV70954
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugcucgugccucgguacgcguuugccauggaacgcaacgcuggguccggaaucauuaucagcgauacacccgugcaugacugcaauaccacaugucaaaccccuaaaggcgccaucaacaccucucugcccuuccagaauauucacccgaucacaauuggcaagugcccuaaguaugucaaaagcacgaaacuuagacuggcuaccgggcuccggaacgugcccuccauccagucucgcggacuguuuggcgccauugccggguucaucgagggaggcuggacagggaugguugacggaugguacggcuaucaucaccagaaugaacaaggcagcggguacgcugcggaucuuaaguccacccagaacgccaucgacgagauuacaaauaaggugaacagcgucaucgagaaaaugaauacccaguuuacggcugugggaaaggaguucaaccaccuggagaagagaauugaaaaucucaacaaaaagguugaugacggcuuccuggauaucuggacauacaaugccgagcugcucgugcugcuugaaaacgagcggacccuggacuaucaugauucuaaugucaaaaaccucuacgagaaggugcgcucccagcugaaaaacaaugccaaggaaauugggaacggauguuuugaguucuaucacaagugcgacaauaccuguauggaaagcgucaaaaacggcacauacgauuauccuaaguacucugaggaagcuaaacuuaauagagaggagaucgacggggugaagcuggaauccacccggaucuaucaaauucucgccaucuacagcacaguugcguccucucuggugcuggucgugagccucggcgcuauuuccuuuuggaugugcucuaacggaagccugcagugccgcaucuguauuuga

SEQ ID NO: 186429 - RNA, 1701 nt, Artificial Sequence; identical to SEQ ID NO: 185680
  derived and/or modified sequence opt5 from hemagglutinin__InfluenzaA__ACV70964

SEQ ID NO: 186430 - RNA, 1701 nt, Artificial Sequence; identical to SEQ ID NO: 185680
  derived and/or modified sequence opt5 from hemagglutinin__InfluenzaA__ACV70974

SEQ ID NO: 186431 - RNA, 1701 nt, Artificial Sequence; identical to SEQ ID NO: 186423
  derived and/or modified sequence opt5 from hemagglutinin__InfluenzaA__ACV70984

SEQ ID NO: 186432 - RNA, 1701 nt, Artificial Sequence; identical to SEQ ID NO: 186428
  derived and/or modified sequence opt5 from hemagglutinin__InfluenzaA__ACV70994

SEQ ID NO: 186433 - RNA, 1701 nt, Artificial Sequence; identical to SEQ ID NO: 185680
  derived and/or modified sequence opt5 from hemagglutinin__InfluenzaA__ACV71004

SEQ ID NO: 186434 - RNA, 1701 nt, Artificial Sequence
  derived and/or modified sequence opt5 from hemagglutinin__InfluenzaA__ACV82230
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagccaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaguaucaggcccuuaaugucaccaugccuaacaacgagcaauucgacaaacuguacauuuggggcgugcaccaucccgggacggauaaggaccagaucuuucucuaugcgcaggccucuggacgcauuacaguuuccaccaaaagaagccagcaaacagugaucccuaauauuggcucccggccgcgcgucagaaacauccccucucggaucagcauuuacuggaccaucgugaagccuggggauauucugcugaucaauuccaccggaaaccucauugcuccccgcggcuacuucaaaauccagagcgggaagucuuccaucaugagaagcgacgccccuauuggaaaguguaauucugagugcaucacacccaacggcagcauuccgaaugacaaaccuuuucagaacgugaaucggaucacguauggcgcuuguccccgcuacgucaagcaaaacacccugaaacuugccacagggaugagaaauguuccugaaaagcagacccggggaauuuucggcgcgaucgccggguuuaucgagaacggaugggaaggcaugguggaugggugguauggauuccgccaccaaaauuccgagggcagaggccaggcugccgaccugaaaucuacacaggcugccauugaucagaucaacgggaagcucaaucggcugauuggaaaaaccaacgagaaguuccaccagaucgaaaaggaguuuagcgaaguggagggccgcauucaggaccuugaaaaauacgucgaggauacgaagaucgaccugugguccuauaacgccgagcuccugguggcucuggaaaaucaacauacaauugaucucaccgacagcgagaugaacaaacuguucgaaaagaccaaaaagcagcuuagagagaaugcggaagauauggggaacggaugcuuuaagaucuaccacaaaugugacaaugccugcaucggcucuauucggaacgggacauaugaucaugacguuuacagagacgaggcucugaauaaccgcuuccagaucaagggcguggagcucaaauccggauacaaggauuggauucuguggaucagcuuugccauuucuugcuuccuucugugugucgcccuccugggcuuuaucaugugggcuugccagaaagggaauauccgguguaacauuugcaucuga

SEQ ID NO: 186435 - RNA, 1701 nt, Artificial Sequence
  derived and/or modified sequence opt5 from hemagglutinin__InfluenzaA__ACV82232
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugauggggaaaauuguacccugauugacgcccuccugggagauccccagugcgacggcuuucaaaacaaaaagugggaucuguucgucgagagaagcaaagccuauuccaauuguuacccuuaugacgugcccgauuacgcuucucuccggagccugguugccuccagcgggacgcuugaauuuaacaaugagucuuucaacuggaccggagugacacagaauggcaccuccagcgcuugcauccgcagaucuaacaauuccuuuuucagccggcugaacuggcucacacaucugaauuuuaaguauccugcccuuaacgucaccaugcccaacaaugagcaguucgacaagcuguacauuuggggcgugcaccauccugggacggauaaagaccagaucuuucucuaugcgcaagccucuggacgcauuacaguuuccaccaagagaagccagcaggcugugaucccgaacauuggcucccggccccgcgucagaaauaucccuucucggaucagcauuuacuggacaaucgugaaacccggggauauucugcugaucaacuccaccggaaaucucauugccccucgcggcuacuucaagaucagaagcgggaaaucuuccaucaugcggagcgacgcucccauuggaaaguguaacucugaaugcaucaccccgaauggcagcauuccuaacgacaagcccuuucagaaugugaaccgcaucacauauggcgccuguccuagauacgucaaacaaaauacgcugaaacuugcgaccgggaugcggaacguucccgagaagcagacacgcggaauuuucggcgccaucgcuggguuuaucgaaaauggaugggagggcaugguggaugggugguauggauucagacaccagaacuccgagggccggggccaagccgcugaccugaagucuacccaggccgccauugaucagaucaaugggaaacucaacagacugauuggaaagacaaacgaaaaauuccaccagaucgagaaggaauuuagcgagguggaaggccgcauucaagaccuugagaaguacgucgaggauaccaaaaucgaccugugguccuauaaugcugaacuccugguggcgcuggagaaccagcauacgauugaucucacagacagcgaaaugaauaagcuguucgagaaaaccaagaaacagcuucgggaaaacgccgaggauauggggaauggaugcuuuaagaucuaccacaagugugacaacgcuugcaucggcucuauuagaaaugggaccuaugaucaugacguuuaccgcgacgaggcccugaacaaucgguuccagaucaaaggcguggaacucaaguccggauacaaagauuggauucuguggaucagcuuugccauuucuugcuuccuucugugugucgcucuccugggcuuuaucaugugggccugccaaaaggggaacaucagauguaauauuugcaucuga

SEQ ID NO: 186436 - RNA, 1698 nt, Artificial Sequence
  derived and/or modified sequence opt5 from hemagglutinin__InfluenzaA__ACV82233
augaaggugaaacugcucguccugcuuugcaccuucacagccacguacgcugacaccaucuguauuggcuaucacgccaacaauagcacagauaccguugacacagugcuggagaagaacgugaccgucacacauuccgugaaucuccuggaaaacaaucacaacgggaaacuuugccugcucaagggaaucgcgccccugcagcugggcaauuguucuguugcuggguggauucucggaaacccugagugcgaacugcuuaucagcaaagaguccuggucuuacauuguggaaaagccgaaucccgagaacggcaccuguuauccugggcauuuugccgauuacgaggaacugagagagcaacucagcuccgucucuagcuucgaacgguuugagaucuuccccaaggaguccagcuggccuaaucacacggugaccggaguuucugccuccugcagccauaacggcgaaaauucuuuuuaucgcaaccugcuuuggcugacaggcaaaaaugggcucuaccccaaccuguccaagagcuaugcuaacaauaaagagaaggaagugcugguccucuggggagugcaccacccuccgaacaucgccgaccagaaaacccuguaccauacagagaaugcuuacgugucugucguuuccagccacuauuccagaaaguucacccccgaaauugccaagcggccuaaaauccgcgaucaggagggcagaauuaacuacuauuggacgcuucuggagcccggggacacaaucauuuuugaagcgaauggaaaccucaucgccccucgguacgcuuucgcccugucucgcggcuuugggagcggaauuaucaauuccaacgcucccauggauaagugugacgccaaaugccagaccccgcaaggcgcgaucaauagcucucuuccuuuccagaacgugcaucccgugacaauuggcgaguguccuaaguaugucagauccgccaaacugcggauggugaccgggcuccgcaauauccccagcauucagucuagaggacuguuuggcgcuaucgccggguucauugaaggaggcuggaccgggaugguugauggaugguacggcuaucaccaccagaacgagcaaggcagcggguacgcugccgaccagaaguccacacagaaugccaucaacggaaucacgaauaaagugaacucugucauugaaaagaugaacacccaguuuacagcugugggcaaggaguucaauaaacuggagcggcgcauggaaaaccucaauaagaaaguugaugacggguucaucgauauuuggaccuacaacgcggagcugcuugugcugcucgaaaaugagagaacacuggacuuucaugacagcaacgucaagaaucuuuaugaaaaagugaagucccaacugaagaacaaugccaaagagaucggaaacggcugcuucgaguuuuaccacaaguguaaugaugaaugcauggagagcgucaaaaacgggaccuaugacuaccccaaguauucugaagaguccaaacucaaucgggagaagauugauggcgugaagcuggaaagcaugggaguuuaccagauccuggcuaucuauucuacgguggccuccagccucguccugcuugugucccugggcgccauuucuuucuggaugugcagcaacgggucccuccagugucgcaucugcauuuga

SEQ ID NO: 186437 - RNA, 1701 nt, Artificial Sequence
  derived and/or modified sequence opt5 from hemagglutinin__InfluenzaA__ACV83662
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgauagagaggggcggaugaauuacuauuggacccugguugaacccggagacaagauuacguucgaggccacaggcaaccugguggugccucgcuacgcguuugccauggucagaaacgcugggucuggaaucauuaucuccgauacccccgugcaugacugcaauacaaccugucagaccccuaaaggcgccaucaacacaagccuccccuuccaaaauauucacccgaucacgauuggcaagugcccuaaguauguuaaaucuaccaagcugcggcuugcuacagggcugcgcaacgugcccagcauccaguccagaggacucuuuggcgccauugccggguucaucgaaggaggcuggaccgggauggucgacggaugguacggcuaucaucaccagaaugagcagggcucuggguacgcugcggaucugaaaagcacacaaaacgccaucgacgaaauuaccaauaaggugaacuccguuaucgagaaaaugaauacgcaguuuacagcugugggaaaggaguucaaccaccuugaaaagcggauugagaaucugaacaaaaaggucgaugacggcuuccucgauaucuggaccuacaaugccgaacugcuggugcuccuggagaacgaacgcacccuugacuaucaugauagcaaugucaaaaaccuguacgagaaggugagaucucagcucaaaaacaaugccaaggagauugggaacggauguuuugaguucuaucacaagugcgacaauacauguauggaguccguuaaaaacggcaccuacgauuauccuaaguacagcgaagaggcuaaacugaaucgggaagagaucgacggggugaaacuugagucuacacgcaucuaucagauucuggccaucuacuccacggucgcgagcucccucgugcugguugugucucugggcgcuauuagcuuuuggaugugcuccaacggaucucuccaaugcagaaucuguauuuga

SEQ ID NO: 186438 - RNA, 1701 nt, Artificial Sequence
  derived and/or modified sequence opt5 from hemagglutinin__InfluenzaA__ACV83663
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgggcaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgauggcguuaaacuugaaucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 186439 - RNA, 1701 nt, Artificial Sequence; identical to SEQ ID NO: 186438
  derived and/or modified sequence opt5 from hemagglutinin__InfluenzaA__ACV83664

SEQ ID NO: 186440 - RNA, 1701 nt, Artificial Sequence
  derived and/or modified sequence opt5 from hemagglutinin__InfluenzaA__ACV83665
auggaggccauccuggugguccuccuguacaccuucgcuacagccaacgcggacacgcuuugcauuggcuaucacgcuaauaacagcaccgauacaguugacaccgugcuggaaaagaaugugacagucacccauuccgugaaccuccuggaggauaaacacaaugggaagcuguguaaacugagaggaguugcgccccuccaucugggcaagugcaacaucgccggguggauucugggaaauccugaaugugagucucucagcacagcuuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaaaaccagcucuuggccuaaucacgauuccaacaagggagugacagccgcuuguccccaugccggcgccaagagcuuuuauaaaaaucugaucuggcucguuaagaaaggcaacucuuacccuaagcuguccaaaagcuauauuaaugacaaggggaaggaggugcuuguccuguggggaauccaccaccccuccaccauugccgaucaacagucucucuaccagaacgcugacgccuacguguucgugggcagcuccagauauagcaaaaaguuuaaaccugagaucgcuauucggccgaagguccgcgaucaggaagggagaaugaauuacuauuggacacugguugagcccggagacaaaaucaccuucgaagccacgggcaaccugguggugccucgguacgcguuugccauggagcgcaacgcugggucuggaauuaucaucuccgauacacccguccaugacugcaauaccacaugucaaaccccuaagggcgccauuaacaccagccuccccuuccacaauauccauccgauuacaaucggcaaaugcccuaaguaugugaagucuacgaaacugagacuugcuaccgggcugcggaacguucccagcauucagucccgcggacucuuuggcgccaucgccggguucaucgaaggaggcuggacagggaugguggacggaugguacggcuaucaccaccagaaugagcagggcucuggguacgcugcggaucuuaagagcacccaaaacgccauugacgagaucacaaauaaagucaacuccgugauugaaaagaugaauacccaguuuacggcuguuggaaaagaguucaaccaucuugaaaagagaaucgagaaucugaacaagaaaguggaugacggcuuccucgauauuuggacauacaaugccgaacugcugguccuccuggagaacgagcggacccuugacuaucacgauagcaaugugaagaaccuguacgaaaaaguccgcucucagcucaagaacaaugccaaagagaucgggaacggauguuuugaguucuaucauaagugcgacaauaccuguauggaauccgugaagaacggcacauacgauuauccuaaauacagcgaagaggcuaagcugaauagagaggaaaucgacgggguuaaacuugagucuacccggauuuaucagauccuggccauuuacuccacaguggcgagcucccucguccuggugguuucucugggcgcuaucagcuuuuggaugugcuccaacggaucucuccaaugccgcauuuguaucuga

SEQ ID NO: 186441 - RNA, 1701 nt, Artificial Sequence
  derived and/or modified sequence opt5 from hemagglutinin__InfluenzaA__ACV83667
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcaaucaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186442 - RNA, 1701 nt, Artificial Sequence; identical to SEQ ID NO: 185693
  derived and/or modified sequence opt5 from hemagglutinin__InfluenzaA__ACV83668

SEQ ID NO: 186443 - RNA, 1701 nt, Artificial Sequence; identical to SEQ ID NO: 185693
  derived and/or modified sequence opt5 from hemagglutinin__InfluenzaA__ACV83670

SEQ ID NO: 186444 - RNA, 1701 nt, Artificial Sequence; identical to SEQ ID NO: 185935
  derived and/or modified sequence opt5 from hemagglutinin__InfluenzaA__ACV83671

SEQ ID NO: 186445 - RNA, 1701 nt, Artificial Sequence; identical to SEQ ID NO: 186255
  derived and/or modified sequence opt5 from hemagglutinin__InfluenzaA__ACV88399

SEQ ID NO: 186446 - RNA, 1701 nt, Artificial Sequence; identical to SEQ ID NO: 186255
  derived and/or modified sequence opt5 from hemagglutinin__InfluenzaA__ACV88409

SEQ ID NO: 186447 - RNA, 1701 nt, Artificial Sequence; identical to SEQ ID NO: 185680
  derived and/or modified sequence opt5 from hemagglutinin__InfluenzaA__ACV88419

SEQ ID NO: 186448 - RNA, 1698 nt, Artificial Sequence; identical to SEQ ID NO: 186302
  derived and/or modified sequence opt5 from hemagglutinin__InfluenzaA__ACV89502

SEQ ID NO: 186449 - RNA, 1701 nt, Artificial Sequence
  derived and/or modified sequence opt5 from hemagglutinin__InfluenzaA__ACV89516
augaaggccagacugcucauccugcuuugcgcucuggccgcgaccgacgcugauacaauuuguaucggcuaccacgccaacaauagcacggacaccguggauacaguccucgagaaaaacguuaccgugacacauuccgugaaucugcuugaagacucucacaacgggaagcugugccggcucaaaggaauugcuccccugcagcugggcaaguguaauaucgccggguggauucucggaaacccugagugcgauagccugcuuccggccuccucuuggagcuauaucgucgaaacccccaauuccaaaaacggcaucuguuacccuggggacuucauugauuaugaggaacugcgcgagcaacucucuagcguguccagcuuugagagauucgaaaucuuucccaaggagucuuccuggccuaagcauagcacaaccaaaggaguuacggcugccugcucucacgcgggcaaguccagcuucuaccggaaucugcuuuggcugaccaaaaagggcgacucuuaucccaaacucuccaacagcuacgugaauaagaaggggaaagaaguccuggugcuguggggaguucaucacccuuccucuagcaaggagcagcagacacucuaucagaacgagaaugccuacguguccgucgugagcucuaacuacaaucgcagauuuauuccggaaaucgcugagcggcccgaagugaaagaucaagccggccgcauuaacuauuacuggacccugcuugagccuggggacacaaucauuuucgaagcuaacggaaaucuggucgcccccugguaugcguuugcccucuccagaggcuucgggagcggaaucaucaccucuaacgcuagcaugcacgaguguaauacgaagugccagacaccucagggcgccauuaacuccucucugcccuuucagaauauccauccgguuaccauuggcgaguguccuaaauacgugaaaagcgcuaaacuucggauggugacagggcugcgcaacauccccuccauucaaagcagaggacucuucggcgccaucgccggguuuaucgaaggaggcuggaccgggaugauugauggaugguauggcuaccaccaucagaaugagcagggcucuggguaugcugcggaccagaaguccacccaaaacgccaucaauggaauuacaaacaaggucaauagcgugaucgaaaagaugaacacgcaguucaccgcuguuggcaaggaguuuaauaaccuggaaaaacggauggagaaucugaacaagaaaguggaugacggguuccucgacauuuggacauacaacgccgagcugcuuguccugcucgaaaaugagcgcacccuggauuuccacgacucuaacgugaagaaucuuuacgaaaagguuaaaauccagcugaagaacaaugccaaagagaucggaaacggcugcuuugaguucuaucacaagugugauaaugaaugcauggaguccgugagaaacgggacauacgacuauccuaaauacagcaaggaauccaagcucaaucgggagaaaauugauggcgucaagcuggaaucuaugggaguguaucaaauccuggcuauuuacagcaccgucgccuccucucucgugcugcuuguuagccugggcgcgaucuccuuuuggaugugcagcaacgggucucuccagugucgcauuugcaucuga

SEQ ID NO: 186450 - RNA, 1698 nt, Artificial Sequence
  derived and/or modified sequence opt5 from hemagglutinin__InfluenzaA__ACV90512
augaacgugaagcugcucguccugcuuugcaccuucacagccacguacgcugacaccaucuguauuggcuaucacgccaauaacagcacagauaccguugacacagugcuggagaaaaaugugaccgucacacauuccgugaaccuccuggaaaauucucacaacgggaaacuuugccugcucaaaggaaucgcgccccugcagcugggcaauuguagcguugcuggguggauucucggaaacccugagugcgaacugcuuaucuccaaggagucuuggagcuacauuguggaaaaaccgaaucccgagaacggcaccuguuauccugggcauuuugccgauuacgaggaacugagagagcaacucuccucugucagcuccuucgaacgguuugagaucuuccccaaggagagcucuuggccuaaucacacggugaccggaguuuccgccagcugcucucauaacggcgaaaauuccuuuuaucgcaaccugcuuuggcugacaggcaagaaugggcucuaccccaaccugagcaaaucuuaugcuaacaauaaggagaaagaagugcugguccucuggggagugcaccacccuccgaacaucgccgaccagaagacccuguaccauacagagaaugcuuacguguccgucguuagcucccacuauucuagaaaauucacccccgaaauugccaagcggccuaaggugcgcgaucaggagggcagaaucaacuacuauuggacgcuucuggagcccggggacacaauuaucuuugaagcgaauggaaaccucauugccccucgguacgcuuucgcccugagccgcggcuuuggguccggaaucauuaauagcaacgcucccaucgauaaaugggacgccaagugucagaccccgcaaggcgcgaucaauucuucccuuccuuuccagaacgugcaucccgucacaauuggcgaguggccuaaauaugugagaagcgccaagcugcggaugguuaccgggcuccgcaauauccccucuauucagagcagaggacuguuuggcgcuaucgccggguucauugaaggaggcuggaccgggaugguggauggaugguacggcuaucaccaccagaacgagcaaggcuccggguacgcugccgaccagaaaucuacacagaaugccaucaacggaaucacgaauaagaugaacagcgucauugaaaagaugaacacccaguuuacagcugugggcaaggaguucaauaagcuggagcggcgcauggaaaaccucaauaaaaagguugaugacggguucaucgauauuuggaccuacaacgcggagcugcuugugcugcucgaaaaugagagaacacuggacuuucaugacuccaacgucaaaaaucuuuaugaaaaggugaaaagccaacugaagaacaaugccaaggagaucggaaacggcugcuucgaguuuuaccacaaauguaaugaugaaugcauggagucugucaagaacgggaccuaugacuaccccaaauauuccgaagagagcaagcucaaucgggagaaaauugauggcgugacgcuggaaucuaugggaguuuaccagauccuggcuaucuauuccacaguggccagcucccucguccugcuugugucucugggcgccauuagcuucuggauguguuccaacgggucucuccagugccgcaucugcauuuga

SEQ ID NO: 186451 - RNA, 1701 nt, Artificial Sequence; identical to SEQ ID NO: 185693
  derived and/or modified sequence opt5 from hemagglutinin__InfluenzaA__ACV91672

SEQ ID NO: 186452 - RNA, 1701 nt, Artificial Sequence; identical to SEQ ID NO: 185693
  derived and/or modified sequence opt5 from hemagglutinin__InfluenzaA__ACV91676

SEQ ID NO: 186453 - RNA, 1701 nt, Artificial Sequence; identical to SEQ ID NO: 185693
  derived and/or modified sequence opt5 from hemagglutinin__InfluenzaA__ACV91680

SEQ ID NO: 186454 - RNA, 1701 nt, Artificial Sequence
  derived and/or modified sequence opt5 from hemagglutinin__InfluenzaA__ACX31591
augaagaccaucauugcccugagcuacauccucugccugguguucgcucagaaacuucccggcaacgacaauuccacagccacgcugugucucgggcaccaugcggucccuaacggaaccauuguuaagacaaucaccaaugaucaaauugaggugacaaacgcuaccgaacuggugcagucuagcuccacaggcgagaucugcgacucuccgcaccagauccuugaugggaaaaauuguacccugauugacgcccuccugggagauccccagugcgacggcuuucaaaacaagaaaugggaucuguucgucgaaagaagcaaggccuauuccaauuguuacccuuaugacgugcccgauuacgcuucucuccggagccugguugccuccagcgggacgcuugaguuuaacaaugaaucuuucaacuggaccggagugacacagaauggcaccuccagcgcuugcauccgcagaucuaagaacuccuuuuucagccggcugaauuggcucacacaucugaacuuuaaauaucaggcccuuaaugucaccaugccuaacaacgagcaguucgacaagcuguacauuuggggcgugcaccaucccgggacggauaaagaccaaaucuuucucuaugcgcaggccucuggacgcauuacaguuuccaccaagagaagccagcagacagugaucccuaauauuggcucccggccgcgcgucagaaacauccccucucggaucagcauuuacuggaccaucgugaaaccuggggauauucugcugaucaauuccaccggaaaccucauugcuccccgcggcuacuucaagauccaaagcgggaagucuuccaucaugagaagcgacgccccuauuggaaaauguaauucugagugcaucacacccaacggcagcauuccgaaugacaagccuuuucagaacgugaaucggaucacguauggcgcuuguccccgcuacgucaaacagaacacccugaaacuugccacagggaugagaaauguuccugaaaaacaaacccggggaauuuucggcgcgaucgccggguuuaucgagaacggaugggaaggcaugguggaugggugguauggauuccgccaccaaaauuccgagggcagaggccaggcugccgaccugaagucuacacaggcugccauugaucagaucaacgggaaacucaaucggcugauuggaaagaccaacgagaaguuccaccagaucgaaaaagaguuuagcgaaguggagggccgcauucaggaccuugaaaaguacgucgaggauacgaaaaucgaccugugguccuauaacgccgagcuccugguggcucuggaaaaucagcauacaauugaucucaccgacagcgagaugaacaagcuguucgaaaagaccaagaagcaacuuagagagaaugcggaagauauggggaacggaugcuuuaaaaucuaccacaagugugacaaugccugcaucggcucuauucggaacgggacauaugaucaugacguuuacagagacgaggcucugaauaaccgcuuccagaucaaaggcguggagcucaaguccggauacaaagauuggauucuguggaucagcuuugccauuucuugcuuccuucugugugucgcccuccugggcuuuaucaugugggcuugccagaaggggaauauccgguguaacauuugcaucuga

SEQ ID NO: 186455 - RNA, 1701 nt, Artificial Sequence
  derived and/or modified sequence opt5 from hemagglutinin__InfluenzaA__ACX31933
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcggcaacgggacgugcuauccgggagacuuuauugauuacgaagaacugcgggagcagcuuuccagcgucucuuccuucgaacgcuuugagaucuuccccaagaccagcucuuggccuaaucacgacuccaacaagggcgugacagccgcuuguccccaugccggcgcgaaaucuuuuuauaagaaucugaucuggcucguuaaaaaggggaacagcuacccuaaacuguccaagagcuauauuaaugauaagggaaaagaagugcuuguccuguggggcauccaccaccccuccaccucugccgaccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucaacggcguuaaacuugaaucuacacggaucuaucaaauucuggccaucuacuccacgguggcgagcucccucguccuggugguuucucugggagcuauuagcuuuuggaugugcuccaauggcucucuccagugccgcaucuguauuuga

SEQ ID NO: 186456 - RNA, 1701 nt, Artificial Sequence
  derived and/or modified sequence opt5 from hemagglutinin__InfluenzaA__ACX31934
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauuaccauccggccgaaaguccgcgggcaggagggaagaaugaauuacuauuggacgcugguugaacccggcgauaagauuacauucgaggcuaccgggaaccugguggugccucgguacgccuuugcgauggaacgcaacgccggaucuggcaucauuaucuccgacacacccguccaugauugcaauaccaccugucaaacaccuaaaggcgcuaucaacacgagccuccccuuccagaauauucacccgaucaccauugggaagugcccuaaguaugugaaaucuacaaagcugagacuugccaccggacugcggaacguucccagcauccagucccgcggccucuuuggggcuauugccggauucaucgagggcggguggacaggaaugguggacggcugguacggcuaucaucaccagaaugaacaagggucuggauacgccgcugaccugaaaagcacccagaacgcgaucgaugagauuacgaauaaggucaacuccgugaucgagaaaaugaauacacaguuuaccgccguuggcaaggaguucaaccaccuugagaagagaauugaaaaucugaacaaaaagguggacgauggguuccucgacaucuggaccuacaaugcugagcugcugguccuccuggaaaacgagcggacacuugauuaucaugacagcaaugugaaaaaccuguacgagaagguccgcucucagcucaaaaacaaugccaaggaaauuggaaacggcuguuuugaguucuaucacaagugcgauaauaccuguauggaauccgugaaaaacgggacauacgacuauccuaaguacagcgaggaagccaaacugaauagagaggagaucgauggcguuaaacuugaaucuacgcggaucuaucaaauucuggcuaucuacuccaccguggccagcucccucguccuggugguuucucugggagcgauuagcuuuuggaugugcuccaacggcucucuccagugccgcaucuguauuuga

SEQ ID NO: 186457 - RNA, 1701 nt, Artificial Sequence; identical to SEQ ID NO: 185693
  derived and/or modified sequence opt5 from hemagglutinin__InfluenzaA__ACX31935

SEQ ID NO: 186458 - RNA, 1701 nt, Artificial Sequence; identical to SEQ ID NO: 185693
  derived and/or modified sequence opt5 from hemagglutinin__InfluenzaA__ACX31936

SEQ ID NO: 186459 - RNA, 1701 nt, Artificial Sequence; identical to SEQ ID NO: 185784
  derived and/or modified sequence opt5 from hemagglutinin__InfluenzaA__ACX31939

SEQ ID NO: 186460 - RNA, 1701 nt, Artificial Sequence; identical to SEQ ID NO: 185784
  derived and/or modified sequence opt5 from hemagglutinin__InfluenzaA__ACX31940

SEQ ID NO: 186461 - RNA, 1701 nt, Artificial Sequence; identical to SEQ ID NO: 185693
  derived and/or modified sequence opt5 from hemagglutinin__InfluenzaA__ACX31943

SEQ ID NO: 186462 - RNA, 1701 nt, Artificial Sequence; identical to SEQ ID NO: 185693
  derived and/or modified sequence opt5 from hemagglutinin__InfluenzaA__ACX31946

SEQ ID NO: 186463 - RNA, 1701 nt, Artificial Sequence; identical to SEQ ID NO: 185693
  derived and/or modified sequence opt5 from hemagglutinin__InfluenzaA__ACX31947

SEQ ID NO: 186464 - RNA, 1701 nt, Artificial Sequence; identical to SEQ ID NO: 185693
  derived and/or modified sequence opt5 from hemagglutinin__InfluenzaA__ACX31948

SEQ ID NO: 186465 - RNA, 1701 nt, Artificial Sequence
  derived and/or modified sequence opt5 from hemagglutinin__InfluenzaA__ACX31949
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccauuauugcaauacaaccugucaaaccccuaaaggcgccaucaacacaagccuccccuuccagaauauucacccgaucacgauuggcaagugcccuaaguacgugaaaucuaccaagcugagacuugcuacagggcugcggaacguucccagcauccagucccgcggacucuuuggcgccauugccggguucaucgagggaggcuggaccgggaugguggacggaugguauggcuaccaucaccagaaugaacaaggcucuggguacgcugcggaccugaaaagcacacagaacgccaucgaugagauuaccaauaaggucaacuccgugaucgagaaaaugaauacgcaguuuacagcuguuggaaaggaguucaaccaccuugagaagagaauugaaaaucugaacaaaaagguggacgauggcuuccucgacaucuggaccuauaaugccgagcugcugguccuccuggaaaacgagcggacccuugauuaccaugacagcaaugugaaaaaccuguaugaggaaguccgcucucagcucaagaacaaugccaaagagauugggaacggauguuuugaguucuaccacaagugcgauaauacauguauggaauccgugaagaacggcaccuaugacuacccuaaauauagcgaagaggcuaagcugaauagagaggaaaucgaugggguuaaacuugagucuacacggaucuaccaaauucuggccaucuacuccacgguggcgagcucccucguccuggugguuucucugggcgcuauuagcuuuuggaugugcuccaacggaucucuccagugccgcaucuguauuuga

SEQ ID NO: 186466 - RNA, 1701 nt, Artificial Sequence; identical to SEQ ID NO: 185693
  derived and/or modified sequence opt5 from hemagglutinin__InfluenzaA__ACX31950

SEQ ID NO: 186467 - RNA, 1701 nt, Artificial Sequence; identical to SEQ ID NO: 185693
  derived and/or modified sequence opt5 from hemagglutinin__InfluenzaA__ACX31951

SEQ ID NO: 186468 - RNA, 1701 nt, Artificial Sequence; identical to SEQ ID NO: 185693
  derived and/or modified sequence opt5 from hemagglutinin__InfluenzaA__ACX31954

SEQ ID NO: 186469 - RNA, 1701 nt, Artificial Sequence; identical to SEQ ID NO: 185693
  derived and/or modified sequence opt5 from hemagglutinin__InfluenzaA__ACX31955

SEQ ID NO: 186470 - RNA, 1701 nt, Artificial Sequence; identical to SEQ ID NO: 185680
  derived and/or modified sequence opt5 from hemagglutinin__InfluenzaA__ACX31956

SEQ ID NO: 186471 - RNA, 1701 nt, Artificial Sequence; identical to SEQ ID NO: 185693
  derived and/or modified sequence opt5 from hemagglutinin__InfluenzaA__ACX31957

SEQ ID NO: 186472 - RNA, 1701 nt, Artificial Sequence; identical to SEQ ID NO: 185680
  derived and/or modified sequence opt5 from hemagglutinin__InfluenzaA__ACX31958

SEQ ID NO: 186473 - RNA, 1701 nt, Artificial Sequence; identical to SEQ ID NO: 185935
  derived and/or modified sequence opt5 from hemagglutinin__InfluenzaA__ACX31960

SEQ ID NO: 186474 - RNA, 1701 nt, Artificial Sequence
  derived and/or modified sequence opt5 from hemagglutinin__InfluenzaA__ACX31961
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucugcccuuccagaauauucacccgaucacaauuggcaagugcccuaaguaugugaaaagcacgaagcucagacuggcuaccgggcuucggaacguucccuccauccagucucgcggacuguuuggcgccauugccggguucaucgagggaggcuggacagggaugguggacggaugguacggcuaucaucaccagaaugaacaaggcagcggguacgcugcggaucucaaauccacccagaacgccaucgacgagauuacaaauaaggucaacagcgugaucgagaaaaugaauacccaguuuacggcuguuggaaaggaguucaaccaccuggagaagagaauugaaaaucuuaacaaaaagguggaugacggcuucauggauaucuggacauacaaugccgagcugcucguccugcuggaaaacgagcggacccucgacuaucaugauucuaaugugaaaaaccuguacgagaagguccgcucccagcuuaaaaacaaugccaaggaaauugggaacggauguuuugaguucuaucacaagugcgacaauaccuguauggaaagcgugaaaaacggcacauacgauuauccuaaguacucugaggaagcuaaacugaauagagaggagaucgacgggguuaagcucgaauccacccggaucuaucaaauucuggccaucuacagcacaguggcguccucucuuguccuggugguuagccucggcgcuauuuccuuuuggaugugcucuaacggaagccugcagugccgcaucuguauuuga

SEQ ID NO: 186475 - RNA, 1701 nt, Artificial Sequence; identical to SEQ ID NO: 185693
  derived and/or modified sequence opt5 from hemagglutinin__InfluenzaA__ACX31962

SEQ ID NO: 186476 - RNA, 1701 nt, Artificial Sequence; identical to SEQ ID NO: 185693
  derived and/or modified sequence opt5 from hemagglutinin__InfluenzaA__ACX31964

SEQ ID NO: 186477 - RNA, 1701 nt, Artificial Sequence; identical to SEQ ID NO: 185680
  derived and/or modified sequence opt5 from hemagglutinin__InfluenzaA__ACX35237

SEQ ID NO: 186478 - RNA, 1701 nt, Artificial Sequence; identical to SEQ ID NO: 185693
  derived and/or modified sequence opt5 from hemagglutinin__InfluenzaA__ACX35247

SEQ ID NO: 186479 - RNA, 1701 nt, Artificial Sequence; identical to SEQ ID NO: 185693
  derived and/or modified sequence opt5 from hemagglutinin__InfluenzaA__ACX35257

SEQ ID NO: 186480 - RNA, 1701 nt, Artificial Sequence; identical to SEQ ID NO: 185693
  derived and/or modified sequence opt5 from hemagglutinin__InfluenzaA__ACX35267

SEQ ID NO: 186481 - RNA, 1701 nt, Artificial Sequence; identical to SEQ ID NO: 185693
  derived and/or modified sequence opt5 from hemagglutinin__InfluenzaA__ACX35277

SEQ ID NO: 186482 - RNA, 1701 nt, Artificial Sequence; identical to SEQ ID NO: 185693
  derived and/or modified sequence opt5 from hemagglutinin__InfluenzaA__ACX35287

SEQ ID NO: 186483 - RNA, 1701 nt, Artificial Sequence; identical to SEQ ID NO: 185693
  derived and/or modified sequence opt5 from hemagglutinin__InfluenzaA__ACX35297

SEQ ID NO: 186484 - RNA, 1701 nt, Artificial Sequence
  derived and/or modified sequence opt5 from hemagglutinin__InfluenzaA__ACX35307
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguuggacccggcgacaagauuacguucgaagccacagggaaccugguggugccucgguacgcguuugccauggagcgcaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgaaggcggguggaccggaaugguggacggcugguacggcuaucaucaccagaaugagcaagggucuggauacgcugcggaucugaaaagcacacagaacgccaucgacgaaauuaccaauaaggucaacuccgugaucgagaaaaugaauacgcaguuuacagcuguuggcaaggaguucaaccaccuugaaaagagaauugagaaucugaacaaaaagguggaugacggguuccucgauaucuggaccuacaaugccgaacugcugguccuccuggagaacgaacggacccuugacuaucaugauagcaaugugaaaaaccuguacgagaagguccgcucucagcucaaaaacaaugccaaggagauuggaaacggcuguuuugaguucuaucacaagugcgacaauacauguauggaguccgugaaaaacgggaccuacgauuauccuaaguacagcgaagaggcuaaacugaauagagaagagaucgacggcguuaaacuugagucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 186485 - RNA, 1701 nt, Artificial Sequence; identical to SEQ ID NO: 185935
  derived and/or modified sequence opt5 from hemagglutinin__InfluenzaA__ACX35317

SEQ ID NO: 186486 - RNA, 1701 nt, Artificial Sequence
  derived and/or modified sequence opt5 from hemagglutinin__InfluenzaA__ACX35327
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacuccuacguguucgugggcacaagcagauauucuaagaaauuuaagccugagauugccauccggccgaaaguccgcgaucaggaggggagaaugaauuacuauuggacccugguugaacccggagacaagauuacguucgaggcuacaggcaaccugguggugccucgguacgccuuugcgauggaacgcaacgccggguccggaaucauuaucagcgauacccccguccaugacugcaauacaaccugucaaaccccuaaaggcgcuaucaacacaucucuccccuuccagaauauucacccgaucacgauuggcaagugcccuaaguaugugaaaagcaccaagcugagacuugccacagggcugcggaacguucccuccauccagucucgcggacucuuuggcgcuauugccggguucaucgagggaggcuggaccgggaugguggacggaugguacggcuaucaucaccagaaugaacaaggcagcggguacgccgcugaucugaaauccacacagaacgcgaucgacgagauuaccaauaaggucaacagcgugaucgagaaaaugaauacgcaguuuacagccguuggaaaggaguucaaccaccuugagaagagaauugaaaaucugaacaaaaagguggaugacggcuuccucgauaucuggaccuacaaugcugagcugcugguccuccuggaaaacgagcggacccuugacuaucaugauucuaaugugaaaaaccuguacgagaagguccgcucccagcucaaaaacaaugccaaggaaauugggaacggauguuuugaguucuaucacaagugcgacaauacauguauggaaagcgugaaaaacggcaccuacgauuauccuaaguacucugaggaagccaaacugaauagagaggagaucgacgggguuaaacuugaauccacacggaucuaucaaauucuggcuaucuacagcacgguggccuccucucucguccuggugguuagccugggcgcgauuuccuuuuggaugugcucuaacggaagccuccagugccgcaucuguauuuga

SEQ ID NO: 186487 - RNA, 1701 nt, Artificial Sequence
  derived and/or modified sequence opt5 from hemagglutinin__InfluenzaA__ACX36501
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagcauuuaccagaacgcugacgccuacguguucgugggcacauccagauauagcaagaaauuuaagccugagaucgcuauucggccgaaaguccgcgaucaggaggggagaaugaauuacuauuggacccucguugaacccggagacaagaucacguucgaggccacaggcaaccugguggugccucgguacgcguuugccauggaacgcaacgcugggucuggaauuaucaucuccgauacccccguccaugacugcaauacaaccugucaaaccccuaaaggcgccauuaacacaagccugcccuuccagaauauccacccgauuacgaucggcaagugcccuaaguaugugaaaucuaccaagcucagacuggcuacagggcuucggaacguucccagcauucagucccgcggacuguuuggcgccaucgccggguucaucgagggaggcuggaccgggaugguggacggaugguacggcuaucaucaccagaaugaacaaggcucuggguacgcugcggaucucaaaagcacacagaacgccauugacgagaucaccaauaaggucaacuccgugauugagaaaaugaauacgcaguuuacagcuguuggaaaggaguucaaccaccuggagaagagaaucgaaaaucuuaacaaaaagguggaugacggcuuccuggauauuuggaccuacaaugccgagcuccugguccugcucgaaaacgagcggacccuggacuaucaugauagcaaugugaaaaaccuuuacgagaagguccgcucucagcugaaaaacaaugccaaggaaaucgggaacggauguuuugaguucuaucacaagugcgacaauacauguauggaauccgugaaaaacggcaccuacgauuauccuaaguacagcgaggaagcuaaacucaauagagaggagaucgacgggguuaagcuggaaucuacacggauuuaucaaauccuugccauuuacuccacgguggcgagcucccugguccucgugguuucucugggcgcuaucagcuuuuggaugugcuccaacggaucucugcagugccgcauuuguaucuga

SEQ ID NO: 186488 - RNA, 1701 nt, Artificial Sequence
  derived and/or modified sequence opt5 from hemagglutinin__InfluenzaA__ACX36502
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagcaucuaccagaacgcugacgccuacgucuucgugggaacauccagauauagcaagaaauuuaagccugagauugcuauccggccgaaagugcgcgaucaggaggggagaaugaauuacuauuggacccucgucgaacccggagacaagauuacguucgaggccacaggcaaccugguugugccucgguacgcguuugccauggaacgcaacgcugggucuggaaucaucauuuccgauacccccgugcaugacugcaauacaaccugucaaaccccuaaaggcgccaucaacacaagccugcccuuccagaauauucacccgaucacgauuggcaagugcccuaaguaugucaaaucuaccaagcucagacuggcuacagggcuucggaacgugcccagcauccagucccgcggacuguuuggcgccaucgccggguucauugagggaggcuggaccgggaugguugacggaugguacggcuaucaucaccagaaugaacaaggcucuggguacgcugcggaucucaaaagcacacagaacgccaucgacgagauuaccaauaaggugaacuccgucaucgagaaaaugaauacgcaguuuacagcugugggaaaggaguucaaccaccuggagaagagaauugaaaaucuuaacaaaaagguugaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaaugccaaggaaaucgggaacggauguuuugaguucuaucacaagugcgacaauacauguauggaauccgucaaaaacggcaccuacgauuauccuaaguacagcgaggaagcuaaacucaauagagaggagauugacggggugaagcuggaaucuacacggaucuaucaaauucuugccaucuacuccacgguugcgagcucccuggugcucgucgugucucugggcgcuauuagcuuuuggaugugcuccaacggaucucugcagugccgcaucuguauuuga

SEQ ID NO: 186489 - RNA, 1701 nt, Artificial Sequence
  derived and/or modified sequence opt5 from hemagglutinin__InfluenzaA__ACX36503
augaaggccauccuggugguccuccuguacaccuucgcuacagccaacgcggacacgcuuugcauuggcuaucacgcuaauaacagcaccgauacaguugacaccauccuggagaaaaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagcaucuaccagaacgcugacgccuacgucuucgugggaacauccagauauagcaagaaauuuaagccugagauugcuauccggccgaaagugcgcgaucaggaggggagaaugaauuacuauuggacccucgucgaacccggagacaagauuacguucgaggccacaggcaaccugguugugccucgguacgcguuugccauggaacgcaacgcugggucuggaaucaucauuuccgauacccccgugcaugacugcaauacaaccugucaaaccccuaaaggcgccaucaacacaagccugcccuuccagaauauucacccgaucacgauuggcaagugcccuaaguaugucaaaucuaccaagcucagacuggcuacagggcuucggaacgugcccagcauccagucccgcggacuguuuggcgccaucgccggguucauugagggaggcuggaccgggaugguugacggaugguacggcuaucaucaccagaaugaacaaggcucuggguacgcugcggaucucaaaagcacacagaacgccaucgacgagauuaccaauaaggugaacuccgucaucgagaaaaugaauacgcaguuuacagcugugggaaaggaguucaaccaccuggagaagagaauugaaaaucuuaacaaaaagguugaugacggcuuccuggauaucuggaccuacaaugccgagcuccuggugcugcucgaaaacgagcggacccuggacuaucaugauagcaaugucaaaaaccuuuacgagaaggugcgcucucagcugaaaaacaauacaaaggaaaucgggaacggauguuuugaguucuaucacaagugcgacaauaccuguauggaauccgucaaaaacggcacauacgauuauccuaaguacagcgaggaagccaaacucaauagagaggagauugacggggugaagcuggaaucuacgcggaucuaucaaauucuugcuaucuacuccaccguugccagcucccuggugcucgucgugucucugggcgcgauuagcuuuuggaugugcuccaacggaucucugcagugccgcaucuguauuuga

SEQ ID NO: 186490 - RNA, 1701 nt, Artificial Sequence
  derived and/or modified sequence opt5 from hemagglutinin__InfluenzaA__ACX47367
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguuaagccuggagacaaaauuacguucgaagccacaggcaaccugguggugccccgguacgcguuugccauggagcgcaacgcugggagcggaaucauuaucucugauaccccuguccaugacugcaauacaaccugucaaacccccaagggcgccaucaacacaucccucccguuccagaauauucacccuaucacgauuggcaagugccccaaauaugugaaaagcaccaaacugagacuugcuacagggcugcggaacguuccuucuauccagagccgcggacucuuuggcgccauugccggguucaucgaaggaggcuggaccgggaugguggacggaugguacggcuaucaucaccagaaugagcaaggcuccggguacgcugcggaucugaagucuacacagaacgccaucgacgaaauuaccaauaaagucaacagcgugaucgagaagaugaauacgcaguuuacagcuguuggaaaggaguucaaccaccuugaaaagagaauugagaaucugaacaagaaaguggaugacggcuuccucgauaucuggaccuacaaugccgaacugcugguccuccuggagaacgaacggacccuugacuaucaugauuccaaugugaagaaccuguacgagaaaguccgcagccagcucaagaacaaugccaaggagauugggaacggauguuuugaguucuaucacaaaugcgacaauacauguauggagucugugaagaacggcaccuacgauuaucccaaauacuccgaagaggcuaagcugaauagagaagagaucgacgggguuaaacuugagagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 186491 - RNA, 1701 nt, Artificial Sequence
  derived and/or modified sequence opt5 from hemagglutinin__InfluenzaA__ACX47368
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaaaggcgccaucaacacaucccucccguuccagaauauucacccuaucacgauuggcaagugccccaaguaugugaaaagcaccaagcugagacuugcuacagggcugcggaacguuccuucuauccagagccgcggacucuuuggcgccauugccggguucaucgagggaggcuggaccgggaugguggacggaugguacggcuaucaucaccagaaugaacaaggcuccggguacgcugcggaucugaaaucuacacagaacgccaucgacgagauuaccaauaaggucaacagcgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauuccaaugugaaaaaccuguacgagaagguccgcagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaauagagaggagaucgacgggguuaaacuugaaagcacacggaucuaucaaauucuggccaucuacucuacgguggcguccagccucguccuggugguuucccugggcgcuauuucuuuuuggaugugcagcaacggaucccuccagugccgcaucuguauuuga

SEQ ID NO: 186492 - RNA, 1701 nt, Artificial Sequence; identical to SEQ ID NO: 186491
  derived and/or modified sequence opt5 from hemagglutinin__InfluenzaA__ACX47369

SEQ ID NO: 186493 - RNA, 1701 nt, Artificial Sequence
  derived and/or modified sequence opt5 from hemagglutinin__InfluenzaA__ACX47370
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgauagacaaucucucuaccagaacgcugacgccuacguguucgugggcacaagccgguauuccaagaaauuuaagccggagauugcuauccgccccaaagucagagaucaggaggggcggaugaauuacuauuggacccugguugaaccuggagacaagauuacguucgaggccacaggcaaccugguggugccccgcuacgcguuugccauggaaagaaacgcugggagcggaaucauuaucucugauaccccuguccaugacugcaauacaaccugucagacccccaaaggcgccaucaacacaucccucccguuccaaaauauucacccuaucacgauuggcaagugccccaaguaugugaaaagcaccaagcugcggcuugcuacagggcugcgcaacguuccuucuauccagagcagaggacucuuuggcgccauugccggguucaucgagggaggcuggaccgggaugguggacggaugguacggcuaucaucaccagaaugaacagggcuccggguacgcugcggaucugaaaucuacacaaaacgccaucgacgagauuaccaauaaggucaacagcgugaucgagaaaaugaauacgcaguuuacagcuguuggaaaggaguucaaccaccuugagaagcggauugaaaaucugaacaaaaagguggaugacggcuuccucgauaucuggaccuacaaugccgagcugcugguccuccuggaaaacgagcgcacccuugacuaucaugauuccaaugugaaaaaccuguacgagaaggucagaagccagcucaaaaacaaugccaaggaaauugggaacggauguuuugaguucuaucacaagugcgacaauacauguauggaaucugugaaaaacggcaccuacgauuaucccaaguacuccgaggaagcuaaacugaaucgggaggagaucgacgggguuaaacuugaaagcacacgcaucuaucagauucuggccaucuacucuacgguggcguccagccucguccuggugguuucccugggcgcuauuucuuuuuggaugugcagcaacggaucccuccaaugcagaaucuguauuuga

SEQ ID NO: 186494 - RNA, 1701 nt, Artificial Sequence; identical to SEQ ID NO: 186491
  derived and/or modified sequence opt5 from hemagglutinin__InfluenzaA__ACX47371

SEQ ID NO: 186495 - RNA, 1701 nt, Artificial Sequence; identical to SEQ ID NO: 186491
  derived and/or modified sequence opt5 from hemagglutinin__InfluenzaA__ACX47372

SEQ ID NO: 186496 - RNA, 1701 nt, Artificial Sequence; identical to SEQ ID NO: 186491
  derived and/or modified sequence opt5 from hemagglutinin__InfluenzaA__ACX47373

SEQ ID NO: 186497 - RNA, 1701 nt, Artificial Sequence; identical to SEQ ID NO: 186491
  derived and/or modified sequence opt5 from hemagglutinin__InfluenzaA__ACX47374

SEQ ID NO: 186498 - RNA, 1701 nt, Artificial Sequence
  derived and/or modified sequence opt5 from hemagglutinin__InfluenzaA__ACX47375
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgaucccaacaagggagugacagccgcuuguccucaugccggcgcgaaauccuuuuauaagaaucugaucuggcucguuaaaaagggcaacagcuaccccaaacugucuaaguccuauauuaaugacaaggggaaagaagugcuuguccuguggggaauccaccacccuagcaccuccgccgaucaacagucucucuaccagaacgcugacgccuacguguucgugggcacaagcagauauuccaagaaauuuaagccggagauugcuauccggcccaaaguccgcgaucaggaggggagaaugaauuacuauuggacccugguugaaccuggagacaagauuacguucgaggccacaggcaaccugguggugccccgguacgcguuugccauggaacgcaacgcugggagcggaaucauuaucucugauaccccuguccaugacugcaauacaaccugucaaacccccaacggcgccaucaauacaucccucccguuccagaacauucacccuaucacgauuggcaaaugccccaaguauguuaagagcaccaaacugagacuugcuacagggcugcggaaugugccuucuauccagagccgcggacucuuuggcgccauugccggguucaucgagggaggcuggaccgggaugguggacggaugguacggcuaucaucaccagaacgaacaaggcuccggguacgcugcggaucugaagucuacacagaaugccaucgacgagauuaccaacaaagucaauagcgugaucgagaagaugaacacgcaguuuacagcuguuggaaaagaguucaaucaccuugagaagagaauugaaaaccugaauaagaaaguggaugacggcuuccucgauaucuggaccuacaacgccgagcugcugguccuccuggaaaaugagcggacccuugacuaucaugauuccaacgugaagaaccuguacgagaaaguccgcagccagcucaagaauaacgccaaagaaauugggaauggauguuuugaguucuaucacaagugcgacaacacauguauggaaucugugaagaauggcaccuacgauuaucccaaauacuccgaggaagcuaagcugaacagagaggagaucgacgggguuaaacuugaaagcacacggaucuaucaaauucuggccaucuacucuacgguggcguccagccucguccuggugguuucccugggcgcuauuucuuuuuggaugugcagcaauggaucccuccagugccgcaucuguauuuga

SEQ ID NO: 186499 - RNA, 1701 nt, Artificial Sequence; identical to SEQ ID NO: 186491
  derived and/or modified sequence opt5 from hemagglutinin__InfluenzaA__ACX47376

SEQ ID NO: 186500 - RNA, 1701 nt, Artificial Sequence; identical to SEQ ID NO: 186491
  derived and/or modified sequence opt5 from hemagglutinin__InfluenzaA__ACX47377

SEQ ID NO: 186501 - RNA, 1701 nt, Artificial Sequence
  derived and/or modified sequence opt5 from hemagglutinin__InfluenzaA__ACX47380
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugucauggaacgcaacgcggggucuggaaucauuaucuccgauacacccgugcaugacugcaauaccaccugucaaacaccuaaaggcgccaucaacacgagccuccccuuccagaauauucacccgaucaccauuggcaagugcccuaaguauguuaaaucuacaaagcugagacuugcuaccgggcugcggaacgugcccagcauccagucccgcggacucuuuggcgccauugcuggguucaucgagggaggcuggacagggauggucgacggaugguacggcuaucaucaccagaaugaacaaggcucuggguacgccgccgaucugaaaagcacccagaacgcuaucgacgagauuacgaauaaggugaacuccguuaucgagaaaaugaauacacaguuuaccgcggugggaaaggaguucaaccaccuugagaagagaauugaaaaucugaacaaaaaggucgaugacggcuuccucgauaucuggaccuacaaugccgagcugcuggugcuccuggaaaacgagcggacacuugacuaucaugauagcaaugucaaaaaccuguacgagaaggugcgcucucagcucaaaaacaaugcuaaggaaauugggaacggauguuuugaguucuaucacaagugcgacaauaccuguauggaauccguuaaaaacggcacauacgauuauccuaaguacagcgaggaagccaaacugaauagagaggagaucgacggggugaaacuugaaucuacgcggaucuaucaaauucuggccaucuacuccaccgucgcuagcucccucgugcugguugugucucugggcgccauuagcuuuuggaugugcuccaacggaucucuccagugccgcaucuguauuuga

SEQ ID NO: 186502 - RNA, 1701 nt, Artificial Sequence; identical to SEQ ID NO: 186501
  derived and/or modified sequence opt5 from hemagglutinin__InfluenzaA__ACX47381

SEQ ID NO: 186503 - RNA, 1701 nt, Artificial Sequence; identical to SEQ ID NO: 186501
  derived and/or modified sequence opt5 from hemagglutinin__InfluenzaA__ACX47382

SEQ ID NO: 186504 - RNA, 1701 nt, Artificial Sequence
  derived and/or modified sequence opt5 from hemagglutinin__InfluenzaA__ACX47383
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgccgccuguccccaugcuggcgccaagagcuuuuauaaaaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagagaagaucgacgggguuaaacuugagucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 186505 - RNA, 1701 nt, Artificial Sequence
  derived and/or modified sequence opt5 from hemagglutinin__InfluenzaA__ACX47384
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacaaccuccucuuggagcuacaucguggagacguccucuagcgacaacgggaccugcuauccgggcgauuuuauugacuacgaagaacugcgggagcagcuuuccagcgucucuuccuucgaacgcuuugagaucuuccccaagacaagcucuuggccuaaucacgauuccaacaagggagugaccgccgccuguccccaugcuggcgccaagagcuuuuauaagaaucugaucuggcucguuaaaaagggcaacucuuacccuaaacuguccaagagcuauauuaaugacaaggggaaagaagugcuuguccuguggggaauccaccaccccuccacaucugcggaucaacagagccucuaccagaacgccgacgcuuacguguucgugggcaccuccagauauagcaagaaauuuaagccugagauugccauccggccgaaaguccgcgaucaggaggggagaaugaauuacuauuggacgcugguugaacccggagacaagauuacauucgaggcuaccggcaaccugguggugccucgguacgccuuugcgauggaacgcaacgccgggucuggaaucauuaucuccgauacacccguccaugacugcaauaccaccugucaaacaccuaaaggcgcuaucaacacgagccuccccuuccagaauauucacccgaucaccauuggcaagugcccuaaguaugugaaaucuacaaagcugagacuugccaccgggcugcggaacguucccagcauccagucccgcggacucuuuggcgcuauugccggguucaucgagggaggcuggacagggaugguggacggaugguacggcuaucaucaccagaaugaacaaggcucuggguacgccgcugaucugaaaagcacccagaacgcgaucgacgagauuacgaauaaggucaacuccgugaucgagaaaaugaauacacaguuuaccgccguuggaaaggaguucaaccaccuugagaagagaauugaaaaucugaacaaaaagguggaugacggcuuccucgauaucuggaccuacaaugcugagcugcugguccuccuggaaaacgagcggacacuugacuaucaugauagcaaugugaaaaaccuguacgagaagguccgcucucagcucaaaaacaaugccaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacgcggaucuaucaaauucuggcuaucuacuccaccguggccagcucccucguccuggugguuucucugggcgcgauuagcuuuuggaugugcuccaacggaucucuccagugccgcaucuguauuuga

SEQ ID NO: 186506 - RNA, 1701 nt, Artificial Sequence; identical to SEQ ID NO: 186505
  derived and/or modified sequence opt5 from hemagglutinin__InfluenzaA__ACX47385

SEQ ID NO: 186507 - RNA, 1701 nt, Artificial Sequence; identical to SEQ ID NO: 186505
  derived and/or modified sequence opt5 from hemagglutinin__InfluenzaA__ACX47387

SEQ ID NO: 186508 - RNA, 1701 nt, Artificial Sequence; identical to SEQ ID NO: 185693
  derived and/or modified sequence opt5 from hemagglutinin__InfluenzaA__ACX55834

SEQ ID NO: 186509 - RNA, 1701 nt, Artificial Sequence; identical to SEQ ID NO: 186491
  derived and/or modified sequence opt5 from hemagglutinin__InfluenzaA__ACX61574

SEQ ID NO: 186510 - RNA, 1701 nt, Artificial Sequence; identical to SEQ ID NO: 185693
  derived and/or modified sequence opt5 from hemagglutinin__InfluenzaA__ACX61575

SEQ ID NO: 186511 - RNA, 1701 nt, Artificial Sequence
  derived and/or modified sequence opt5 from hemagglutinin__InfluenzaA__ACX83577
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucuuuuagcacauccucuagcugguccuacaucguggagaccucuagcuccgacaacggcacgugcuauccgggggauuucauugacuacgaagaacuccgggagcagcugagcucugucuccagcuuugaacgcuucgagaucuuucccaagaccucuuccuggccuaaucacgauagcaacaagggagugacagccgccuguccccaugcuggcgccaaaucuuucuauaagaaucuuaucuggcugguuaaaaagggcaacuccuacccuaaacucagcaaguccuauauuaaugacaaggggaaagaagugcugguccuuuggggaauccaccaccccucuaccagcgcggaucaacagucccuguaccagaacgccgacgcuuacguguuugugggcacaagcagauauucuaagaaauucaagccugagauugccauccggccgaaaguccgcgggcaggagggaagaaugaauuacuauuggacccucguugaacccggcgauaagauuacguuugaggcuacagggaaccugguggugccucgguacgccuucgcgauggaacgcaacgccggauccggcaucauuaucagcgacacccccguccaugauugcaauacaaccugucaaaccccuaaaggcgcuaucaacacaucucugcccuuucagaauauucacccgaucacgauugggaagugcccuaaguaugugaaaagcaccaagcucagacuggccacaggacuucggaacguucccuccauccagucucgcggccuguucggggcuauugccggauuuaucgagggcggguggaccggaaugguggacggcugguacggcuaucaucaccagaaugaacaagggagcggauacgccgcugaccucaaauccacacagaacgcgaucgaugagauuaccaauaaggucaacagcgugaucgagaaaaugaauacgcaguucacagccguuggcaaggaguucaaccaccuggagaagagaauugaaaaucuuaacaaaaagguggacgauggguuucuggacaucuggaccuacaaugcugagcuccugguccugcucgaaaacgagcggacccuggauuaucaugacucuaaugugaaaaaccuuuacgagaagguccgcucccagcugaaaaacaaugccaaggaaauuggaaacggcuguuucgaguuuuaucacaagugcgauaauacauguauggaaagcgugaaaaacgggaccuacgacuauccuaaguacucugaggaagccaaacucaauagagaggagaucgauggcguuaagcuggaauccacacggaucuaucaaauucuugcuaucuacagcacgguggccuccucucugguccucgugguuagccugggagcgauuuccuucuggaugugcucuaacggcagccugcagugccgcaucuguauuuga

SEQ ID NO: 186512 - RNA, 1701 nt, Artificial Sequence
  derived and/or modified sequence opt5 from hemagglutinin__InfluenzaA__ACX94091
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccaucagcuggccuaaucacgauucuaacaagggagugacagccgcuuguccccaugccggcgcgaaauccuuuuauaagaaucugauuuggcucguuaaaaagggcaacagcuacccuaaacugucuaaguccuauaucaaugacaaggggaaagaagugcuuguccuguggggcauucaccaccccagcaccuccgccgaucaacagucucucuaccagaacgcugacgccuacguguucgugggaacaagcagauauuccaagaaauuuaagccugagaucgcuauucggccgaaaguccgcgaucaggaggggagaaugaauuacuauuggacccugguugaacccggagacaagaucacguucgaggccacaggcaaccugguggugccucgguacgcguuugccauggaacgcaacgcugggagcggaauuaucaucucugauacccccguccaugacugcaauacaaccugucaaaccccuaaaggcgccauuaacacaucccuccccuuccagaauauccacccgauuacgaucggcaagugcagcaaguaugugaaaucuaccaagcugagacuugcuacagggcugcggaacguuccuagcauucagucccgcggacucuuuggcgccaucgccggguucaucgagggaggcuggaccgggaugguggacggaugguacggcuaucaucaccagaaugaacaaggcucuggguacgcugcggaucugaaaagcacacagaacgccauugacgagaucaccaauaaggucaacuccgugauugagaaaaugaauacgcaguuuacagcuguuggaaaggaguucaaccaccuugagaagagaaucgaaaaucugaacaaaaagguggaugacggcuuccucgauauuuggaccuacaaugccgagcugcugguccuccuggaaaacgagcggacccuugacuaucaugauagcaaugugaaaaaccuguacgagaagguccgcucucagcucaaaaacaaugccaaggaaaucgggaacggauguuuugaguucuaucacaagugcgacaauacauguauggaauccgugaaaaacggcaccuacgauuaucccaaguacagcgaggaagcuaaacugaauagagaggagaucgacgggguuaaacuugaaucuacacggauuuaucaaauccuggccauuuacuccacgguggcgagcucccucguccuggugguuucucugggcgcuaucagcuuuuggaugugcuccaacggaucucuccagugccgcauuuguaucuga

SEQ ID NO: 186513 - RNA, 1701 nt, Artificial Sequence
  derived and/or modified sequence opt5 from hemagglutinin__InfluenzaA__ACY26192
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccauaauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacaggaugccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccaacggaucucuccagugccgcaucuguauuuga

SEQ ID NO: 186514 - RNA, 1701 nt, Artificial Sequence; identical to SEQ ID NO: 186262
  derived and/or modified sequence opt5 from hemagglutinin__InfluenzaA__ACY26202

SEQ ID NO: 186515 - RNA, 1701 nt, Artificial Sequence; identical to SEQ ID NO: 185693
  derived and/or modified sequence opt5 from hemagglutinin__InfluenzaA__ACY46103

SEQ ID NO: 186516 - RNA, 1701 nt, Artificial Sequence; identical to SEQ ID NO: 185693
  derived and/or modified sequence opt5 from hemagglutinin__InfluenzaA__ACY46113

SEQ ID NO: 186517 - RNA, 1701 nt, Artificial Sequence
  derived and/or modified sequence opt5 from hemagglutinin__InfluenzaA__ACY46123
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaagucggggaucaggagggacgcaugaauuacuauuggacccugguugaacccggcgacaagauuacguucgaggccacagggaaccugguggugccuagauacgcguuugccauggaacggaacgcuggaucuggcaucauuaucuccgauacccccguccaugacugcaauacaaccugucaaaccccuaaaggcgccaucaacacaagccuccccuuccagaauauucacccgaucacgauugggaagugcccuaaguaugugaaaucuaccaagcugcgccuugcuacaggacugagaaacguucccagcauccagucccggggccucuuuggggccauugccggauucaucgagggcggguggaccggaaugguggacggcugguacggcuaucaucaccagaaugaacaagggucuggauacgcugcggaucugaaaagcacacagaacgccaucgacgagauuaccaauaaggucaacuccgugaucgagaaaaugaauacgcaguuuacagcuguuggcaaggaguucaaccaccuugagaagcgcauugaaaaucugaacaaaaagguggaugacggguuccucgauaucuggaccuacaaugccgagcugcugguccuccuggaaaacgagagaacccuugacuaucaugauagcaaugugaaaaaccuguacgagaagguccggucucagcucaaaaacaaugccaaggaaauuggaaacggcuguuuugaguucuaucacaagugcgacaauacauguauggaauccgugaaaaacgggaccuacgauuauccuaaguacagcgaggaagcuaaacugaaucgcgaggagaucgacggcguuaaacuugaaucuacaagaaucuaucaaauucuggccaucuacuccacgguggcgagcucccucguccuggugguuucucugggagcuauuagcuuuuggaugugcuccaacggcucucuccagugccggaucuguauuuga

SEQ ID NO: 186518 - RNA, 1701 nt, Artificial Sequence; identical to SEQ ID NO: 185693
  derived and/or modified sequence opt5 from hemagglutinin__InfluenzaA__ACY46133

SEQ ID NO: 186519 - RNA, 1701 nt, Artificial Sequence; identical to SEQ ID NO: 185693
  derived and/or modified sequence opt5 from hemagglutinin__InfluenzaA__ACY46163

SEQ ID NO: 186520 - RNA, 1701 nt, Artificial Sequence
  derived and/or modified sequence opt5 from hemagglutinin__InfluenzaA__ACY46173
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaacgcauugaaaaucugaacaagaaaguggaugacggcuuccucgauaucuggacauacaaugccgagcugcugguccuccuggaaaacgagagaacccuugacuaucaugauucuaaugugaagaaccuguacgagaaaguccggucccagcucaagaacaaugccaaggaaauugggaacggauguuuugaguucuaucacaaaugcgacaauaccuguauggaaagcgugaagaacggcacauacgauuauccuaaauacucugaggaagcuaagcugaaucgcgaggagaucgacgggguuaaacuugaauccaccagaaucuaucaaauucuggccaucuacagcacaguggcguccucucucguccuggugguuagccugggcgcuauuuccuuuuggaugugcucuaacggaagccuccagugccggaucuguauuuga

SEQ ID NO: 186521 - RNA, 1701 nt, Artificial Sequence; identical to SEQ ID NO: 185693
  derived and/or modified sequence opt5 from hemagglutinin__InfluenzaA__ACY46213

SEQ ID NO: 186522 - RNA, 1701 nt, Artificial Sequence; identical to SEQ ID NO: 185693
  derived and/or modified sequence opt5 from hemagglutinin__InfluenzaA__ACY46223

SEQ ID NO: 186523 - RNA, 1701 nt, Artificial Sequence; identical to SEQ ID NO: 185693
  derived and/or modified sequence opt5 from hemagglutinin__InfluenzaA__ACY46233

SEQ ID NO: 186524 - RNA, 1701 nt, Artificial Sequence; identical to SEQ ID NO: 185693
  derived and/or modified sequence opt5 from hemagglutinin__InfluenzaA__ACY46243

SEQ ID NO: 186525 - RNA, 1701 nt, Artificial Sequence; identical to SEQ ID NO: 185693
  derived and/or modified sequence opt5 from hemagglutinin__InfluenzaA__ACY46253

SEQ ID NO: 186526 - RNA, 1701 nt, Artificial Sequence; identical to SEQ ID NO: 185693
  derived and/or modified sequence opt5 from hemagglutinin__InfluenzaA__ACY46263

SEQ ID NO: 186527 - RNA, 1701 nt, Artificial Sequence; identical to SEQ ID NO: 185693
  derived and/or modified sequence opt5 from hemagglutinin__InfluenzaA__ACY46273

SEQ ID NO: 186528 - RNA, 1701 nt, Artificial Sequence; identical to SEQ ID NO: 185693
  derived and/or modified sequence opt5 from hemagglutinin__InfluenzaA__ACY46283

SEQ ID NO: 186529 - RNA, 1701 nt, Artificial Sequence
  derived and/or modified sequence opt5 from hemagglutinin__InfluenzaA__ACY46293
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcugccgggcugcggaacguucccagcauccagucccgcggacucuuuggcgccauugcuggguucaucgagggaggcuggacagggaugguggacggaugguacggcuaucaucaccagaaugaacaaggcucuggguacgcggccgaucugaaaagcacccagaacgcuaucgacgagauuacaaauaaggucaacuccgugaucgagaaaaugaauacccaguuuacggccguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauagcaaugugaaaaaccuguacgagaagguccgcucucagcucaaaaacaaugcuaaggaaauugggaacggauguuuugaguucuaucacaagugcgacaauaccuguauggaauccgugaaaaacggcacauacgauuauccuaaguacagcgaggaagccaaacugaauagagaggagaucgacgggguuaaacuugaaucuacccggaucuaucaaauucuggcgaucuacuccacaguggcuagcucccucguccuggugguuucucugggcgccauuagcuuuuggaugugcuccaacggaucucuccagugccgcaucuguauuuga

SEQ ID NO: 186530 - RNA, 1701 nt, Artificial Sequence; identical to SEQ ID NO: 185693
  derived and/or modified sequence opt5 from hemagglutinin__InfluenzaA__ACY46303

SEQ ID NO: 186531 - RNA, 1701 nt, Artificial Sequence; identical to SEQ ID NO: 185693
  derived and/or modified sequence opt5 from hemagglutinin__InfluenzaA__ACY46313

SEQ ID NO: 186532 - RNA, 1701 nt, Artificial Sequence; identical to SEQ ID NO: 185693
  derived and/or modified sequence opt5 from hemagglutinin__InfluenzaA__ACY46323

SEQ ID NO: 186533 - RNA, 1701 nt, Artificial Sequence; identical to SEQ ID NO: 185693
  derived and/or modified sequence opt5 from hemagglutinin__InfluenzaA__ACY46343

SEQ ID NO: 186534 - RNA, 1701 nt, Artificial Sequence; identical to SEQ ID NO: 185693
  derived and/or modified sequence opt5 from hemagglutinin__InfluenzaA__ACY46353

SEQ ID NO: 186535 - RNA, 1701 nt, Artificial Sequence
  derived and/or modified sequence opt5 from hemagglutinin__InfluenzaA__ACY46373
augaaggccauccugauugugcuccuguacaccuucgcuacagccaacgcggacacgcuuugcaucggcuaucacgcuaauaacagcaccgauacagucgacaccguucuggagaagaaugugacagugacccauuccgucaaccuccuggaagauaagcacaaugggaaacuuuguaagcugagaggaguggcuccccuccaucugggcaaaugcaacauugccggguggauccugggaaauccugagugugaaucucucagcacagccuccucuuggagcuacauuguugagaccuccucuagcgacaacggcacgugcuauccgggggauuuuaucgacuacgaagaacugcgggagcagcuuuccagcgugucuuccuucgaacgcuuugagaucuuccccaagaccagcucuuggccuaaucacgauuccaacaagggagucacagccgcuuguccccaugccggcgcgaaaucuuuuuauaagaaucugauuuggcucgugaaaaagggcaacagcuacccuaaacuguccaagagcuauaucaaugacaaggggaaagaaguucuugugcuguggggcauucaccaccccuccaccucugccgaucaacagagccucuaccagaacgcugacgccuacgucuucgugggaacauccagauauagcaagaaauuuaagccugagaucgcuauucggccgaaagugcgcgaucaggaggggagaaugaauuacuauuggacccuggucgaacccggagacaagaucacguucgaggccacaggcaaccugguugugccucgguacgcguuugccauggaacgcaacgcugggucuggaauuaucaucuccgauacccccgugcaugacugcaauacaaccugucaaaccccuaaaggcgccauuaacacaagccuccccuuccagaauauccacccgauuacgaucggcaagugcccuaaguaugucaaaucuaccaagcugagacuugcuacagggcugcggaacgugcccagcauucagucccgcggacucuuuggcgccaucgccggguucaucgagggaggcuggaccgggaugguugacggaugguacggcuaucaucaccagaaugaacaaggcucuggguacgcugcggaucugaaaagcacacagaacgccauugacgagaucaccaauaaggugaacuccgucauugagaaaaugaauacgcaguuuacagcugugggaaaggaguucaaccaccuugagaagagaaucgaaaaucugaacaaaaagguugaugacggcuuccucgauauuuggaccuacaaugccgagcugcuggugcuccuggaaaacgagcggacccuugacuaucaugauagcaaugucaaaaaccuguacgagaaggugcgcucucagcucaaaaacaaugccaaggaaaucgggaacggauguuuugaguucuaucacaagugcgacaauacauguauggaauccgucaaaaacggcaccuacgauuauccuaaguacagcgaggaagcuaaacugaauagagaggagaucgacggggugaaacuugaaucuacacggauuuaucaaauccuggccauuuacuccacgguugcgagcucccucgugcuggucgugucucugggcgcuaucagcuuuuggaugugcuccaacggaucucuccagugccgcauuuguaucuga

SEQ ID NO: 186536 - RNA, 1701 nt, Artificial Sequence
  derived and/or modified sequence opt5 from hemagglutinin__InfluenzaA__ACY46383
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccacaauauucauccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaccaccagaaugaacagggcagcggguacgcugcggaucugaaauccacccaaaacgccaucgacgagauuacaaauaaggucaacagcgugaucgagaaaaugaauacccaguuuacggcuguuggaaaggaguucaaccaucuugagaagagaauugaaaaucugaacaaaaagguggaugacggcuuccucgauaucuggacauacaaugccgagcugcugguccuccuggaaaacgagcggacccuugacuaucacgauucuaaugugaaaaaccuguacgagaagguccgcucccagcucaaaaacaaugccaaggaaauugggaacggauguuuugaguucuaucauaagugcgacaauaccuguauggaaagcgugaaaaacggcacauacgauuauccuaaguacucugaggaagcuaaacugaauagagaggagaucgacgggguuaaacuugaauccacccggaucuaucagauucuggccaucuacagcacaguggcguccucucucguccuggugguuagccugggcgcuauuuccuuuuggaugugcucuaacggaagccuccaaugccgcaucuguauuuga

SEQ ID NO: 186537 - RNA, 1701 nt, Artificial Sequence; identical to SEQ ID NO: 185693
  derived and/or modified sequence opt5 from hemagglutinin__InfluenzaA__ACY46393

SEQ ID NO: 186538 - RNA, 1701 nt, Artificial Sequence; identical to SEQ ID NO: 185693
  derived and/or modified sequence opt5 from hemagglutinin__InfluenzaA__ACY46403

SEQ ID NO: 186539 - RNA, 1701 nt, Artificial Sequence; identical to SEQ ID NO: 185693
  derived and/or modified sequence opt5 from hemagglutinin__InfluenzaA__ACY46413

SEQ ID NO: 186540 - RNA, 1701 nt, Artificial Sequence; identical to SEQ ID NO: 185693
  derived and/or modified sequence opt5 from hemagglutinin__InfluenzaA__ACY46433

SEQ ID NO: 186541 - RNA, 1701 nt, Artificial Sequence; identical to SEQ ID NO: 185693
  derived and/or modified sequence opt5 from hemagglutinin__InfluenzaA__ACY46443

SEQ ID NO: 186542 - RNA, 1701 nt, Artificial Sequence; identical to SEQ ID NO: 185693
  derived and/or modified sequence opt5 from hemagglutinin__InfluenzaA__ACY46453

SEQ ID NO: 186543 - RNA, 1701 nt, Artificial Sequence
  derived and/or modified sequence opt5 from hemagglutinin__InfluenzaA__ACY46463
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcacauccagauauagcaagaaauuuaagccugagauugcuauccggccgaaaguccgcgaucaggaggggagaaugaauuacuauuggacccucguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccugcccuuccagaauauucacccgaucacgauuggcaagugcccuaaguauguuaaaucuaccaagcucagacuggcuacagggcuucggaacgugcccagcauccagucccgcggacuguuuggcgccauugccggguucaucgaaggaggcuggaccgggauggucgacggaugguacggcuaucaucaccagaaugagcaaggcucuggguacgcugcggaucucaaaagcacacagaacgccaucgacgaaauuaccaauaaggugaacuccguuaucgagaaaaugaauacgcaguuuacagcugugggaaaggaguucaaccaccuggaaaagagaauugagaaucuuaacaaaaaggucgaugacggcuuccuggauaucuggaccuacaaugccgaacuccuggugcugcucgagaacgaacggacccuggacuaucaugauagcaaugucaaaaaccuuuacgagaaggugcgcucucagcugaaaaacaaugccaaggagauugggaacggauguuuugaguucuaucacaagugcgacaauacauguauggaguccguuaaaaacggcaccuacgauuauccuaaguacagcgaagaggcuaaacucaauagagaagagaucgacggggugaagcuggagucuacacggaucuaucaaauucuugccaucuacuccacggucgcgagcucccuggugcucguugugucucugggcgcuauuagcuuuuggaugugcuccaacggaucucugcagugccgcaucuguauuuga

SEQ ID NO: 186544 - RNA, 1701 nt, Artificial Sequence; identical to SEQ ID NO: 185693
  derived and/or modified sequence opt5 from hemagglutinin__InfluenzaA__ACY46473

SEQ ID NO: 186545 - RNA, 1701 nt, Artificial Sequence; identical to SEQ ID NO: 185680
  derived and/or modified sequence opt5 from hemagglutinin__InfluenzaA__ACY46493

SEQ ID NO: 186546 - RNA, 1701 nt, Artificial Sequence
  derived and/or modified sequence opt5 from hemagglutinin__InfluenzaA__ACY46513
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaauauguuaagagcacgaaacugcgccuugcuaccgggcugagaaacgugcccuccauccagucucggggacucuuuggcgccauugccggguucaucgagggaggcuggacagggaugguggacggaugguacggcuaucaucaccagaaugaacaaggcagcggguacgcugcggaucugaaguccacccagaacgccaucgacgagauuacaaauaaagucaacagcgugaucgagaagaugaauacccaguuuacggcuguuggaaaggaguucaaccaccuugagaaacgcauugaaaaucugaacaagaaaguggaugacggcuuccucgauaucuggacauacaaugccgagcugcugguccuccuggacaacgaaagaacccuugauuaucaugacucuaaugugaagaaccuguacgagaaaguccggucccagcucaagaacaaugccaaggagauugggaacggauguuuugaguucuaucacaaaugcgauaauaccuguauggaaagcgugaagaacggcacauacgacuauccuaaauacucugaagaggcuaagcugaaucgcgaagagaucgaugggguuaaacuugaguccaccagaaucuaucaaauucuggccaucuacagcacaguggcguccucucucguccuggugguuagccugggcgcuauuuccuuuuggaugugcucuaacggaagccuccagugccggaucuguauuuga

SEQ ID NO: 186547 - RNA, 1701 nt, Artificial Sequence; identical to SEQ ID NO: 185693
  derived and/or modified sequence opt5 from hemagglutinin__InfluenzaA__ACY46523

SEQ ID NO: 186548 - RNA, 1701 nt, Artificial Sequence; identical to SEQ ID NO: 185693
  derived and/or modified sequence opt5 from hemagglutinin__InfluenzaA__ACY46533

SEQ ID NO: 186549 - RNA, 1701 nt, Artificial Sequence; identical to SEQ ID NO: 185693
  derived and/or modified sequence opt5 from hemagglutinin__InfluenzaA__ACY46562

SEQ ID NO: 186550 - RNA, 1701 nt, Artificial Sequence; identical to SEQ ID NO: 185693
  derived and/or modified sequence opt5 from hemagglutinin__InfluenzaA__ACY46572

SEQ ID NO: 186551 - RNA, 1701 nt, Artificial Sequence; identical to SEQ ID NO: 185693
  derived and/or modified sequence opt5 from hemagglutinin__InfluenzaA__ACY46582

SEQ ID NO: 186552 - RNA, 1701 nt, Artificial Sequence; identical to SEQ ID NO: 185693
  derived and/or modified sequence opt5 from hemagglutinin__InfluenzaA__ACY46592

SEQ ID NO: 186553 - RNA, 1701 nt, Artificial Sequence; identical to SEQ ID NO: 185693
  derived and/or modified sequence opt5 from hemagglutinin__InfluenzaA__ACY46622

SEQ ID NO: 186554 - RNA, 1701 nt, Artificial Sequence
  derived and/or modified sequence opt5 from hemagglutinin__InfluenzaA__ACY46672
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccaugguccgcaacgcugggucuggaaucauuaucuccgauacccccgugcaugacugcaauacaaccugucaaaccccuaaaggcgccaucaacacaagccuccccuuccagaauauucacccgaucacgauuggcaagugcccuaaguauguuaaaucuaccaagcugagacuugcuacagggcugcggaacgugcccagcauccagucccgcggacucuuuggcgccauugccggguucaucgaaggaggcuggaccgggauggucgacggaugguacggcuaucaucaccagaaugagcaaggcucuggguacgcugcggaucugaaaagcacacagaacgccaucgacgaaauuaccaauaaggugaacuccguuaucgagaaaaugaauacgcaguuuacagcugugggaaaggaguucaaccaccuugaaaagagaauugagaaucugaacaaaaaggucgaugacggcuuccucgauaucuggaccuacaaugccgaacugcuggugcuccuggagaacgaacggacccuugacuaucaugauagcaaugucaaaaaccuguacgagaaggugcgcucucagcucaaaaacaaugccaaggagauugggaacggauguuuugaguucuaucacaagugcgacaauacauguauggaguccguuaaaaacggcaccuacgauuauccuaaguacagcgaagaggcuaaacugaauagagaagagaucgacggggugaaacuugagucuacacggaucuaucaaauucuggccaucuacuccacggucgcgagcucccucgugcugguugugucucugggcgcuauuagcuuuuggaugugcuccaacggaucucuccagugccgcaucuguauuuga

SEQ ID NO: 186555 - RNA, 1701 nt, Artificial Sequence; identical to SEQ ID NO: 185693
  derived and/or modified sequence opt5 from hemagglutinin__InfluenzaA__ACY46682

SEQ ID NO: 186556 - RNA, 1701 nt, Artificial Sequence; identical to SEQ ID NO: 185693
  derived and/or modified sequence opt5 from hemagglutinin__InfluenzaA__ACY46692

SEQ ID NO: 186557 - RNA, 1701 nt, Artificial Sequence; identical to SEQ ID NO: 185693
  derived and/or modified sequence opt5 from hemagglutinin__InfluenzaA__ACY46712

SEQ ID NO: 186558 - RNA, 1701 nt, Artificial Sequence
  derived and/or modified sequence opt5 from hemagglutinin__InfluenzaA__ACY46722
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccggccaacagagccucuaccagaacgcugaugccuacguguucguggggacauccagauauagcaagaaauuuaagccugagauugcuauccggccgaaaguccgcgaccaggagggaagaaugaauuacuauuggacccugguugaacccggcgauaagauuacguucgaggccacagggaaccugguggugccucgguacgcguuugccauggaacgcaacgcuggaucuggcaucauuaucuccgacacccccguccaugauugcaauacaaccugucaaaccccuaaaggcgccaucaacacaagccuccccuuccagaauauucacccgaucacgauugggaagugcccuaaguaugugaaaucuaccaagcugagacuugcuacaggacugcggaacguucccagcauccagucccgcggccucuuuggggccauugccggauucaucgagggcggguggaccggaaugguggacggcugguacggcuaucaucaccagaaugaacaagggucuggauacgcugcggaccugaaaagcacacagaacgccaucgaugagauuaccaauaaggucaacuccgugaucgagaaaaugaauacgcaguuuacagcuguuggcaaggaguucaaccaccuugagaagagaauugaaaaucugaacaaaaagguggacgauggguuccucgacaucuggaccuacaaugccgagcugcugguccuccuggaaaacgagcggacccuugauuaucaugacagcaaugugaaaaaccuguacgagaagguccgcucucagcucaaaaacaaugccaaggaaauuggaaacggcuguuuugaguucuaucacaagugcgauaauacauguauggaauccgugaaaaacgggaccuacgacuauccuaaguacagcgaggaagcuaaacugaauagagaggagaucgauggcguuaaacuugaaucuacacggaucuaucaaauucuggccaucuacuccacgguggcgagcucccucguccuggugguuucucugggagcuauuagcuuuuggaugugcuccaacggcucucuccagugccgcaucuguauuuga

SEQ ID NO: 186559 - RNA, 1701 nt, Artificial Sequence
  derived and/or modified sequence opt5 from hemagglutinin__InfluenzaA__ACY46742
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccggggaauuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaccugguggugccucgguacgcguuugccauggaacgcaaugcugggucuggaaucauuaucuccgacacccccguccaugauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186560 - RNA, 1701 nt, Artificial Sequence; identical to SEQ ID NO: 185693
  derived and/or modified sequence opt5 from hemagglutinin__InfluenzaA__ACY46762

SEQ ID NO: 186561 - RNA, 1701 nt, Artificial Sequence; identical to SEQ ID NO: 185693
  derived and/or modified sequence opt5 from hemagglutinin__InfluenzaA__ACY46772

SEQ ID NO: 186562 - RNA, 1701 nt, Artificial Sequence; identical to SEQ ID NO: 185693
  derived and/or modified sequence opt5 from hemagglutinin__InfluenzaA__ACY46903

SEQ ID NO: 186563 - RNA, 1701 nt, Artificial Sequence; identical to SEQ ID NO: 185719
  derived and/or modified sequence opt5 from hemagglutinin__InfluenzaA__ACY77534

SEQ ID NO: 186564 - RNA, 1698 nt, Artificial Sequence
  derived and/or modified sequence opt5 from hemagglutinin__InfluenzaA__ACY77544
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacaaccguccaugacugcaauacaaccugucaaacccccaaaggcgccaucaacacaucucugccuuuccagaauauucaccccaucacgauuggcaagugcccgaaguaugugaaaagcaccaagcucagacuggcuacagggcuucggaacguuccuuccauccagucucgcggacuguuuggcgccauugccggguucaucgagggaggcuggaccgggaugguggacggaugguacggcuaucaucaccagaaugaacaaggcagcggguacgcugcggaucucaaauccacacagaacgccaucgacgagauuaccaauaaggucaacagcgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauacauguauggaaagcgugaaaaacggcaccuacgauuaucccaaguacucugaggaagcuaaacucaauagagaggagaucgacgggguuaagcuggaauccacacggaucuaucaaauucuugccaucuacagcacgguggcguccucucugguccucgugguuagccugggcgcuauuuccuuuuggaugugcucuuggagccugcagugccgcaucuguauuuga

SEQ ID NO: 186565 - RNA, 1698 nt, Artificial Sequence
  derived and/or modified sequence opt5 from hemagglutinin__InfluenzaA__ACY77554
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccauaauugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggacggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaccuguacgagaagguccgcucucagcucaaaaauaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccggacaucuccagugccgcaucuguauuuga

SEQ ID NO: 186566 - RNA, 1695 nt, Artificial Sequence
  derived and/or modified sequence opt5 from hemagglutinin__InfluenzaA__ACY77573
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaggaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagagcgccaucgacgagauuacaaacaaggucaauucugugaucgagaaaaugaacacccagcuuacgggacaguguaaggaauuuaaucaccuggagaagagaauugaaaaccucaauaaaaagguugaugacggcuuccuggauaucuggacauacaacgcugagcugcucgugcugcuugaaaaugagcggacccuggacuaucaugauuccaacgucaaaaaucucuacgagaaggugcgcagccaacugaaaaacaacgccaaugaaauugggaacggaugcuucgaguuuuaucacaagugugacaauaccugcauggaaucugucaagaacggcacauacgauuauccuaaauacuccgaggaagccaaacuuaauagagaggagaucgacggggugaagcuggaaagcacccggaucuaucagauucucgcuaucuacuccacaguugccucuagccuggugcuggucgugucccucggcgcgauuucuuucuggaugugcagcggacauuccugucgcaucugcauuuga

SEQ ID NO: 186567 - RNA, 1701 nt, Artificial Sequence
  derived and/or modified sequence opt5 from hemagglutinin__InfluenzaA__ACY77593
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacaaccguccaugacugcaauacaaccugucaaacccccaaaggcgccaucaacacaucucugccuuuccagaauauucaccccaucacgauuggcaagugcccgaaguaugugaaaagcaccaagcucagacuggcuacagggcuucggaacguuccuuccauccagucucgcggacuguuuggcgccauugccggguucaucgagggaggcuggaccgggaugguggacggaugguacggcuaucaucaccagaaugaacaaggcagcggguacgcugcggaucucaaauccacacagaacgccaucgacgagauuaccaauaaggucaacagcgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauacauguauggaaagcgugaaaaacggcaccuacgauuaucccaaguacucugaggaagcuaaacucaauagagaggagaucgacgggguuaagcuggaauccacacggaucuaucaaauucuugccaucuacagcacgguggcguccucucugguccucgugguuagccugggcgcuauuuccuuuuggaugugcucuaacggaagccugcagugccgcaucuguauuuga

SEQ ID NO: 186568 - RNA, 1698 nt, Artificial Sequence
  derived and/or modified sequence opt5 from hemagglutinin__InfluenzaA__ACY77603
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucugcccuuccagaauauucacccgaucacaauuggcaagugcccuaaguaugugaaaagcacgaagcucagacuggcuaccgggcuucggaacguucccuccauccagucucgcggacuguuuggcgccauugccggguucaucgagggaggcuggacagggaugguggacggaugguacggcuaucaucaccagaaugaacaaggcagcggguacgcugcggaucucaaauccacccagaacgccaucgacgagauuacaaauaaggucaacagcgugaucgagaaaaugaauacccaguuuacggcuguuggaaaggaguucaaccaccuggagaagagaauugaaaaucuuaacaaaaagguggaugacggcuuccuggauaucuggacauacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauaccuguauggaaagcgugaaaaacggcacauacgauuauccuaaguacucugaggaagcuaaacucaauagagaggagaucgacgggguuaagcuggaauccacccggaucuaucaaauucuugccaucuacagcacaguggcguccucucugguccucgugguuagccugggcgcuauuuccuuuuggaugugcucuuggagccugcagugccgcaucuguauuuga

SEQ ID NO: 186569 - RNA, 1695 nt, Artificial Sequence
  derived and/or modified sequence opt5 from hemagglutinin__InfluenzaA__ACY77613
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacaggacaguguaaggaguucaaccaccuugagaagagaauugaaaaucugaacaaaaagguugaugacggcuuccucgauaucuggaccuacaaugcugagcugcuggugcuccuggaaaacgagcggacccuugacuaucaugauagcaaugucaaaaaccuguacgagaaggugcgcucucaacucaaaaacaaugccaaggaaauugggaacggaugcuuugaguucuaucacaagugugacaauacaugcauggaauccgucaaaaacggcaccuacgauuauccuaaguacagcgaggaagccaaacugaauagagaggagaucgacggggugaaacuugaaucuacacggaucuaucagauucuggcuaucuacuccacgguugccagcucccucgugcuggucgugucucugggcgcgauuagcuuuuggaugugcuccggacauucuugucgcaucugcauuuga

SEQ ID NO: 186570 - RNA, 1701 nt, Artificial Sequence; identical to SEQ ID NO: 185693
  derived and/or modified sequence opt5 from hemagglutinin__InfluenzaA__ACY77623

SEQ ID NO: 186571 - RNA, 1707 nt, Artificial Sequence
  derived and/or modified sequence opt5 from hemagglutinin__InfluenzaA__ACY77653
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaguggggaacggauguuuugaguucuaucacaagugcgacaauaccuguauggaaagcguuaaaaacggcacauacgauuauccuaaguacucugaggaagcuaaacucaauagagaggagaucgacggggugaagcuggaauccacccggaucuaucaaauucuugccaucuacagcacagucgcguccucucuggugcucguugugagccugggcgcuauuuccuuuuggaugugcucuggacauagcggcucccugcagugccgcaucuguauuuga

SEQ ID NO: 186572 - RNA, 1698 nt, Artificial Sequence
  derived and/or modified sequence opt5 from hemagglutinin__InfluenzaA__ACY77663
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccuggucucuccugugccgcaucuguauuuga

SEQ ID NO: 186573 - RNA, 1698 nt, Artificial Sequence
  derived and/or modified sequence opt5 from hemagglutinin__InfluenzaA__ACY77683
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacggcuguuggaaaggaguucaaccaccuggagaagagaaucgaaaaucuuaacaaaaagguggaugacggcuuccuggauauuuggacauacaaugccgagcuccugguccugcucgaaaacgagcggacccuggacuaucaugauucuaaugugaaaaaccuuuacgagaagguccgcucccagcugaaaaacaaugccaaggaaguggggaacggauguuuugaguucuaucacaagugcgacaauaccuguauggaaagcguuaaaaacggcacauacgauuauccuaaguacucugaggaagcuaaacucaauagagaggagaucgacggggugaagcuggaauccacccggaucuaucaaauucuugccaucuacagcacagucgcguccucucuggugcucguugugagccugggcgcuauuuccuuuuggaugugcucuuggagccugcagugccgcaucuguauuuga

SEQ ID NO: 186574 - RNA, 1698 nt, Artificial Sequence
  derived and/or modified sequence opt5 from hemagglutinin__InfluenzaA__ACY77693
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucacaauucggccgaaaguccgcgaucaggaggggagaaugaauuacuauuggacccucguugaacccggagacaagaucacguucgaggcuacaggcaaccugguggugccucgguacgccuuugcgauggaacgcaacgccggguccggaauuaucaucagcgauacccccguccaugacugcaauacaaccugucaaaccccuaaaggcgcuauuaacacaucucugcccuuccagaauauccacccgauuacgaucggcaagugcccuaaguaugugaaaagcaccaagcucagacuggccacagggcuucggaacguucccuccauucagucucgcggacuguuuggcgcuaucgccggguucaucgagggaggcuggaccgggaugguggacggaugguacggcuaucaucaccagaaugaacaaggcagcggguacgccgcugaucucaaauccacacagaacgcgauugacgagaucaccaauaaggucaacagcgugauugagaaaaugaauacgcaguuuacaggacaguguaaggaguucaaccaccuggagaagagaaucgaaaaucuuaacaaaaagguugaugacggcuuccuggauauuuggaccuacaaugccgagcuccuggugcugcucgaaaacgagcggacccuggacuaucaugauucuaaugucaaaaaccuuuacgagaaggugcgcucccaacugaaaaacaaugcuaaggaagucgggaacggaugcuuugaguucuaucacaagugugacaauacaugcauggaaagcgugaaaaacggcaccuacgauuauccuaaguacucugaggaagccaaacucaauagagaggagaucgacgggguuaagcuggaauccacacggaucuaucagauucuugccaucuacagcacgguggcuuccucucugguccucgugguuagccugggcgccauuuccuuuuggaugugcucuuggagccugcagugucgcaucugcauuuga

SEQ ID NO: 186575 - RNA, 1698 nt, Artificial Sequence
  derived and/or modified sequence opt5 from hemagglutinin__InfluenzaA__ACY77703
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacgggacaguguaaggaguucaaccaccuggagaagagaaucgaaaaucuuaacaaaaagguugaugacggcuuccuggauauuuggacauacaaugcugagcuccuggugcugcucgaaaacgagcggacccuggacuaucaugauucuaaugucaaaaaccuuuacgagaaggugcgcucccaacugaaaaacaaugccaaggaagucgggaacggaugcuuugaguucuaucacaagugugacaauaccugcauggaaagcgugaaaaacggcacauacgauuauccuaaguacucugaggaagccaaacucaauagagaggagaucgacgggguuaagcuggaauccacccggaucuaucagauucuugcuaucuacagcacaguggccuccucucugguccucgugguuagccugggcgcgauuuccuuuuggaugugcucuuggagccugcagugucgcaucugcauuuga

SEQ ID NO: 186576 - RNA, 1698 nt, Artificial Sequence
  derived and/or modified sequence opt5 from hemagglutinin__InfluenzaA__ACY77713
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaagggcaacagcuacccuaaacucuccaagagcuauaucaaugacaaggggaaagaagugcugguccuuuggggcauucaccaccccuccaccucugccgaucaacagagccuguaccagaacgcugacgccuacguguucgugggauccagcagauauucuaagaaauuuaagccugagaucgcuauucggccgaaaguccgcgaucaggaggggagaaugaauuacuauuggacacucguugaacccggagacaagaucaccuucgaggccacgggcaaccugguggugccucgguacgcguuugccauggaacgcaacgcuggguccggaauuaucaucagcgauacacccguccaugacugcaauaccacaugucaaaccccuaaaggcgccauuaacaccucucugcccuuccagaauauccacccgauuacaaucggcaagugcccuaaguaugugaaaagcacgaagcucagacuggcuaccgggcuucggaacguucccuccauucagucucgcggacuguuuggcgccaucgccggguucaucgagggaggcuggacagggaugguggacggaugguacggcuaucaucaccagaaugaacaaggcagcggguacgcugcggaucucaaauccacccagaacgccauugacgagaucacaaauaaggucaacagcgugauugagaaaaugaauacccaguuuacgggacaguguaaggaguucaaccaccuggagaagagaaucgaaaaucuuaacaaaaagguugaugacggcuuccuggauauuuggacauacaaugcugagcuccuggugcugcucgaaaacgagcggacccuggacuaucaugauucuaaugucaaaaaccuuuacgagaaggugcgcucccaacugaaaaacaaugccaaggaagucgggaacggaugcuuugaguucuaucacaagugugacaauaccugcauggaaagcgugaaaaacggcacauacgauuauccuaaguacucugaggaagccaaacucaauagagaggagaucgacgggguuaagcuggaauccacccggaucuaucagauucuugcuaucuacagcacaguggccuccucucugguccucgugguuagccugggcgcgauuuccuuuuggaugugcucuggacaucugcagugucgcaucugcauuuga

SEQ ID NO: 186577 - RNA, 1701 nt, Artificial Sequence; identical to SEQ ID NO: 186006
  derived and/or modified sequence opt5 from hemagglutinin__InfluenzaA__ACY77723

SEQ ID NO: 186578 - RNA, 1695 nt, Artificial Sequence
  derived and/or modified sequence opt5 from hemagglutinin__InfluenzaA__ACY77733
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaacauccucgaagauaagcacaaugggaaacuguguaaacuuagaggaguugcuccccugcaucucggcaagugcaacauugccggguggauccugggaaauccugagugugaaucucugagcacagccuccucuuggagcuacauuguggagaccuccucuagcgacaacggcacgugcuauccgggggauuuuaucgacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuauuuggcugguuaaaaccggcaacagcuacccuaagcucuccaaaagcuauaucaaugacaaggggaaggaagugcugguccuuuggggcauucaccaccccuccacaucugccgaucaacagagccuguaccagaacgcugacgccuacguguucgugggauccagcagauauucuaaaaaguuuaaaccugagaucgcuauucggccgaagguccgcgaucaggaggggagaaugaauuacuauuggacccucguugaacccggagacaaaaucacguucgaggccacaggcaaccugguggugccucgguacgcguuugccauggaacgcaacgcuggguccggaauuaucaucagcgauacccccguccaugacugcaauacaaccugucaaaccccuaagggcgccauuaacacaucucugcccuuccagaauauccacccgauuacgaucggcaaaugcccuaaguauguuaagagcaccaaacucagacuggcuacagggcuucggaacgugcccuccauucagucucgcggacuguuuggcgccaucgccggguucaucgagggaggcuggaccgggaugguggacggaugguacggcuaucaucaccagaaugaacaaggcagcggguacgcugcggaucucaaguccacacagaacgccauugacgagaucaccaauaaagucaacagcgugauugagaagaugaauacgcaguuuacagcuguuggaaaagaguucaaccaccuggagaagagaaucgaaaaucuuaacaagaaaguggaugacggcuuccuggauauuuggaccuacaaugccgagcuccugguccugcucgaaaacgagcggacccuggacuaucaugauucuaaugugaagaaccuuuacgagaaaguccgcucccagcugaagaacaaugccaaagaaaucgggaacggauguuuugaguucuaucacaagugcgacaauacauguauggaaagcgugaagaacggcaccuacgauuauccuaaauacucugaggaagcuaagcucaauagagaggagaucgacgggguuaaacuggaauccacacggauuuaucaaauccuugccauuuacagcacgguggcguccucucugguccucgugguuagccugggcgcuaucuccuuuuggaugugcucuggacugcagugccgcauuuguaucuga

SEQ ID NO: 186579 - RNA, 1698 nt, Artificial Sequence
  derived and/or modified sequence opt5 from hemagglutinin__InfluenzaA__ACY77743
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcuggguccggaaucauuaucagcgauacacccguccaugacugcaauaccacaugucaaaccccuaaaggcgccaucaacaccucucuccccuuccagaauauucacccgaucacaauuggcaagugcccuaaguaugugaaaagcacgaagcugagacuugcuaccgggcugcggaacguucccuccauccagucucgcggacucuuuggcgccauugccggguucaucgagggaggcuggacagggaugguggacggaugguacggcuaucaucaccagaaugaacaaggcagcggguacgcugcggaucugaaauccacccagaacgccaucgacgagauuacaaauaaggucaacagcgugaucgagaaaaugaauacccaguuuacggcuguuggaaaggaguucaaccaccuugagaagagaauugaaaaucugaacaaaaagguggaugacggcuuccucgauaucuggacauacaaugccgagcugcugguccuccuggaaaacgagcggacccuugacuaucaugauucuaaugugaaaaaccuguacgagaagguccgcucccagcucaaaaacaaugccaaggaaguggggaacggauguuuugaguucuaucacaagugcgacaauaccuguauggaaagcguuaaaaacggcacauacgauuauccuaaguacucugaggaagcuaaacugaauagagaggagauugacggggugaaacuugaauccacccggaucuaucaaauccuggccauuuacagcacagucgcguccucucucgugcugguugugagccugggcgcuaucuccuuuuggaugugcucuuggagccuccagugccgcauuuguaucuga

SEQ ID NO: 186580 - RNA, 1701 nt, Artificial Sequence; identical to SEQ ID NO: 185693
  derived and/or modified sequence opt5 from hemagglutinin__InfluenzaA__ACY77753

SEQ ID NO: 186581 - RNA, 1695 nt, Artificial Sequence
  derived and/or modified sequence opt5 from hemagglutinin__InfluenzaA__ACY77783
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccugggggauaagcacaauggaaaacuuuguaagcugagaggcguugcuccccuccaucuggggaaaugcaacaucgccggauggauucugggcaauccugaaugugagucucucagcacagccuccucuuggagcuacaucguggaaaccuccucuagcgacaacgggacgugcuauccgggagauuuuauugacuacgaggaacugcgggagcagcuuuccagcgucucuuccuucgagcgcuuugaaaucuuccccaagaccagcucuuggccuaaucacgauuccgacaagggcgugacagccgcuuguccccaugccggcgcgaaaucuuuuuauaagaaccugaucuggcucguuaaaaaggggaauagcuacccuaaacuguccaagagcuauauuaacgauaagggaaaagaggugcuuguccuguggggcauccaccaccccuccaccucugccgaccaacagagccucuaccagaaugcugauacauacguguucguggggaccuccagauauagcaagaaauuuaagccugaaauugccauccggccgaaaguccgcgaccaggagggaagaaugaacuacuauuggacgcugguugagcccggcgauaagauuacauucgaagcuaccgggaaucugguggugccucgguacgccuuugcgauggagcgcaacgccggaucuggcaucauuaucuccgacacacccguccaugacugcaacaccaccugucaaacaccuaaaggcgcuaucaauacgagccuccccuuccagaacauucacccgaucaccauugggaagugcccuaaguaugugaaaucuacaaagcugagacuugccaccggacugcggaauguucccagcauccagucccgcggccucuuuggggcuauugccggauucaucgaaggcggguggacaggaaugguggauggcugguacggcuaucaucaccagaacgagcaagggucuggauacgccgcugaccugaaaagcacccagaaugcgaucgaugaaauuacgaacaaggucaauuccgugaucgagaaaaugaacacacaguuuaccgccguuggcaaggaguucaaucaccuugaaaagagaauugagaaccugaauaaaaagguggacgauggguuccucgacaucuggaccuacaacgcugaacugcugguccuccuggagaaugaacggacacuugauuaucaugacagcaacgugaaaucucuguacgagaagguccgcucccagcucaaaaauaacgccaaggagauuggaaacggcuguuuugaguucuaucacaagugcgauaauaccuguauggaaagcgugaaaaacgggacauacgacuauccuaaguacucugaagaggccaaacugaauagagaagagaucgauggcguuaaacuugaguccacgcggaucuaucaaauucuggcuaucuacagcaccguggccuccucucucguccuggugguuagccugggagcgauuuccuuuuggaugugcucuggccauagcugccgcaucuguauuuga

SEQ ID NO: 186582 - RNA, 1698 nt, Artificial Sequence
  derived and/or modified sequence opt5 from hemagglutinin__InfluenzaA__ACY77813
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacaggacaguguaaggaguucaaccaccuugagaagagaauugaaaaucugaacaaaaagguugaugacggcuuccucgauaucuggaccuacaaugcugagcugcuggugcuccuggaaaacgagcggacccuugacuaucaugauagcaaugucaaaaaccuguacgagaaggugcgcucucaacucaaaaacaaugccaaggaaauugggaacggaugcuuugaguucuaucacaagugugacaauacaugcauggaauccgucaaaaacggcaccuacgauuauccuaaguacagcgaggaagccaaacugaauagagaggagaucgacggggugaaacuugaaucuacacggaucuaucagauucuggcuaucuacuccacgguugccagcucccucgugcuggucgugucucugggcgcgauuagcuuuuggaugugcuccggacaucuccagugucgcaucugcauuuga

SEQ ID NO: 186583 - RNA, 1698 nt, Artificial Sequence
  derived and/or modified sequence opt5 from hemagglutinin__InfluenzaA__ACY77823
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacaggacaguguaaggaguucaaccaccuugagaagagaauugaaaaucugaacaaaaagguugaugacggcuuccucgauaucuggaccuacaaugcugagcugcuggugcuccuggaaaacgagcggacccuugacuaucaugauagcaaugucaaaaaccuguacgagaaggugcgcucucaacucaaaaacaaugccaaggaaauugggaacggaugcuuugaguucuaucacaagugugacaauacaugcauggaauccgucaaaaacggcaccuacgauuauccuaaguacagcgaggaagccaaacugaauagagaggagaucgacggggugaaacuugaaucuacacggaucuaucagauucuggcuaucuacuccacgguugccagcucccucgugcuggucgugucucugggcgcgauuagcuuuuggaugugcuccuggucucuccagugucgcaucugcauuuga

SEQ ID NO: 186584 - RNA, 1698 nt, Artificial Sequence
  derived and/or modified sequence opt5 from hemagglutinin__InfluenzaA__ACY77833
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccuggucucuccagugccgcaucuguauuuga

SEQ ID NO: 186585 - RNA, 1698 nt, Artificial Sequence
  derived and/or modified sequence opt5 from hemagglutinin__InfluenzaA__ACY77843
augaaggccauccugguggucaugcucuacaccuucgcuacagccaacgcggacacgcugugcauuggcuaucacgcuaauaacagcaccgauacaguugacaccgugcuugagaaaaaugugacagucacccauuccgugaaccugcucgaagauaagcacaaugggaaacuguguaaacuuagaggaguugcuccccugcaucucggcaagugcaacaucgccggguggauucugggaaauccugagugugaaucucugagcacagccuccucuuggagcuacaucguggagaccuccucuagcgacaacggcacgugcuauccgggggauuuuauugacuacgaagaacuccgggagcagcuguccagcgucucuuccuucgaacgcuuugagaucuuccccaagaccagcucuuggccuaaucacgauuccaacaagggagugacagccgcuuguccccaugccggcgcgaaaucuuuuuauaagaaucuuaucuggcugguuaaaaagggcaacagcuacccuaaacucuccaagagcuauauuaaugacaaggggaaagaagugcugguccuuuggggaauccaccaccccuccaccucugccgaucaacagagccuguaccagaacgcugacgccuacguguucgugggcuccagcagauauucuaagaaauuuaagccugagauugcuauccggccgaaaguccgcgaucaggaggggagaaugaauuacuauuggacacucguugaacccggagacaagauuaccuucgaggccacgggcaaccugguggugccucgguacgcguuugccauggaacgcaacgcuggguccggaaucauuaucagcgauacaaccguccaugacugcaauacaaccugucaaacccccaaaggcgccaucaacacaucucugccuuuccagaauauucaccccaucacgauuggcaagugcccgaaguaugugaaaagcaccaagcucagacuggcuacagggcuucggaacguuccuuccauccagucucgcggacuguuuggcgccauugccggguucaucgagggaggcuggaccgggaugguggacggaugguacggcuaucaucaccagaaugaacaaggcagcggguacgcugcggaucucaaauccacacagaacgccaucgacgagauuaccaauaaggucaacagcgugaucgagaaaaugaauacgcaguuuacagcuguuggaaaggaguucaaccaccuggagaagagaauugaaaaucuuaacaaaaagguggaugacggcuuccuggauaucuggaccuacaaugccgagcuccugguccugcucgaaaacgagcggacccuggacuaucaugauucuaaugugaaaaaccuuuacgagaagguccgcucccagcugaaaaacaaugccaaggaaauugggaacggauguuuugaguucuaucacaagugcgacaauacauguauggaaagcgugaaaaacggcaccuacgauuaucccaaguacucugaggaagcuaaacucaauagagaggagaucgacgggguuaagcuggaauccacacggaucuaucaaauucuugccaucuacagcacgguggcguccucucugguccucgugguuagccugggcgcuauuuccuuuuggaugugcucuggacaucugcagugccgcaucuguauuuga

SEQ ID NO: 186586 - RNA, 1701 nt, Artificial Sequence
  derived and/or modified sequence opt5 from hemagglutinin__InfluenzaA__ACY77863
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcacauccagauauagcaagaaauuuaagccugagauugcuauccggccgaaaguccgcgaucaggaggggagaaugaauuacuauuggacccugguugaacccggagacaagauuacguucgaggccacaggcaaccugguggugccucgguacgcguuugccauggaacgcaacgcugggucuggaaucauuaucuccgauacccccguccaugacugcaauacaaccugucaaaccccuaaaggcgccaucaacacaagccuccccuuccagaauauucacccgaucacgauuggcaagugcccuaaguaugugaaaucuaccaagcugagacuugcuacagggcugcggaacguucccagcauccagucccgcggacucuuuggcgccauugccggguucaucgagggaggcuggaccgggaugguggacggaugguacggcuaucaucaccagaaugaacaaggcucuggguacgcugcggaucugaaaagcacacagaacgccaucgacgagauuaccaauaaggucaacuccgugaucgagaaaaugaauacgcaguuuacagcuguuggaaaggaguucaaccaccuugagaagagaauugaaaaucugaacaaaaagguggaugacggcuuccucgauaucuggaccuacaaugccgagcugcugguccuccuggaaaacgagcggacccuugacuaucaugauagcaaugugaaaaaccuguacgagaagguccgcucucagcucaaaaacaaugccaaggaaauugggaacggauguuuugaguucuaucacaagugcgacaauacauguauggaauccgugaaaaacggcaccuacgauuauccuaaguacagcgaggaagcuaaacugaauagagaggagaucgacgggguuaaacuugaaucuacacggaucuaucaaauucuggccaucuacuccacgguggcgagcucccucguccuggugguuucucugggcgcuauuagcuuuuggaugugcuccggaaugucucuccagugccgcaucuguauuuga

SEQ ID NO: 186587 - RNA, 1701 nt, Artificial Sequence; identical to SEQ ID NO: 185680
  derived and/or modified sequence opt5 from hemagglutinin__InfluenzaA__ACY77874

SEQ ID NO: 186588 - RNA, 1701 nt, Artificial Sequence; identical to SEQ ID NO: 185680
  derived and/or modified sequence opt5 from hemagglutinin__InfluenzaA__ACY77884

SEQ ID NO: 186589 - RNA, 1701 nt, Artificial Sequence
  derived and/or modified sequence opt5 from hemagglutinin__InfluenzaA__ACY77904
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcaaguauucuaaaaaguuuaaaccugagauugcuaucagaccgaagguccgggaucaggaggggcgcaugaauuacuauuggacacugguugaacccggagacaaaauuaccuucgaggccacgggcaaccugguggugccuagauacgcguuugccauggaacggaacgcuggguccggaaucauuaucagcgauacacccguccaugacugcaauaccacaugucaaaccccuaagggcgccaucaacaccucucuccccuuccagaauauucacccgaucacaauuggcaagugcccuaaacauguuaagagcacgaaacugcgccuugcuaccgggcugagaaacgugcccuccauccagucucggggacucuuuggcgccauugccggguucaucgagggaggcuggacagggaugguggacggaugguauggcuaccaccaccagaaugaacaaggcagcggguaugcugcggaucugaaguccacccagaacgccaucgacgagauuacaaauaaagucaacagcgugaucgagaagaugaauacccaguuuacggcuguuggaaaggaguucaaccaucuugagaaacgcauugaaaaucugaacaagaaaguggaugacggcuuccucgauaucuggacauacaaugccgagcugcugguccuccuggaaaacgagagaacccuugacuaccacgauucuaaugugaagaaccuguaugagaaaguccggucccagcucaagaacaaugccaaggaaauugggaacggauguuuugaguucuaccauaaaugcgacaauaccuguauggaaagcgugaagaacggcacauaugauuacccuaaauauucugaggaagcuaagcugaaucgcgaggagaucgacgggguuaaacuugaauccaccagaaucuaccaaauucuggccaucuauagcacaguggcguccucucucguccuggugguuagccugggcgcuauuuccuuuuggaugugcucuaacggaagccuccagugccggaucuguauuuga

SEQ ID NO: 186590 - RNA, 1701 nt, Artificial Sequence; identical to SEQ ID NO: 185873
  derived and/or modified sequence opt5 from hemagglutinin__InfluenzaA__ACY77914

SEQ ID NO: 186591 - RNA, 1701 nt, Artificial Sequence
  derived and/or modified sequence opt5 from hemagglutinin__InfluenzaA__ACY77924
augaaggccauccuggugguccuccuguacaccuucgcuacagccaacgcggacacgcuuugcauuggcuaucacgcuaauaacagcaccgauacaguugacaccgugcuggagaagaaugugacagucacccauuccgugaaccuccuggaagauaagcacgacgggaaacuuuguaagcugagaggaguugcuccccuccaucugggcaaaugcaauaucgccggguggauucugggaaacccugagugugaaucucucagcacagccuccucuuggagcuacaucguggagaccuccucuagcgauaauggcacgugcuauccgggggacuuuauugauuacgaagaacugcgggagcagcuuuccagcgucucuuccuucgaacgcuuugagaucuuccccaagaccagcucuuggccuaaccacgacuccaauaagggagugacagccgcuuguccccaugccggcgcgaaaucuuuuuauaagaaccugaucuggcucguuaaaaagggcaauagcuacccuaaacuguccaagagcuauauuaacgauaaggggaaagaagugcuuguccuguggggaauccaccaccccuccaccucugccgaccaacagagccucuaccagaaugcugaugccuacguguucgugggcacauccagauauagcaagaaauuuaagccugagauugcuauccggccgaaaguccgcgaccaggaggggagaaugaacuacuauuggacccugguugaacccggagauaagauuacguucgaggccacaggcaaucugguggugccucgguacgcguuugccauggaacgcaacgcugggucuggaaucauuaucuccgacacccccguccaugacugcaacacaaccugucaaaccccuaaaggcgccaucaauacaagccuccccuuccagaacauucacccgaucacgauuggcaagugcccuaaguaugugaaaucuaccaagcugagacuugcuacagggcugcggaauguucccagcauccagucccgcggacucuuuggcgccauugccggguucaucgagggaggcuggaccgggaugguggauggaugguacggcuaucaucaccagaacgaacaaggcucuggguacgcugcggaccugaaaagcacacagaaugccaucgaugagauuaccaacaaggucaauuccgugaucgagaaaaugaacacgcaguuuacagcuguuggaaaggaguucaaucaccuugagaagagaauugaaaaccugaauaaaaagguggacgauggcuuccucgacaucuggaccuacaacgccgagcugcugguccuccuggaaaaugagcggacccuugauuaucaugacagcaacgugaaaaaucuguacgagaagguccgcucucagcucaaaaacaacgccaaggaaauugggaauggauguuuugaguucuaucacaagugcgauaacacauguauggaauccgugaaaaauggcaccuacgacuauccuaaguacagcgaggaagcuaaacugaacagagaggagaucgaugggguuaaacuugaaucuacacggaucuaucaaauucuggccaucuacuccacgguggcgagcucccucguccuggugguuucucugggcgcuauuagcuuuuggaugugcuccaauggaucucuccagugccgcaucuguauuuga

SEQ ID NO: 186592 - RNA, 1701 nt, Artificial Sequence; identical to SEQ ID NO: 186441
  derived and/or modified sequence opt5 from hemagglutinin__InfluenzaA__ACY77934

SEQ ID NO: 186593 - RNA, 1701 nt, Artificial Sequence
  derived and/or modified sequence opt5 from hemagglutinin__InfluenzaA__ACY77944
augaaggccauccuggugguccuccuguacaccuucgcuacagccaacgcggacacgcuuugcauuggcuaucacgcuaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugagugugaaucucucagcacagccuccucuuggagcuacaucguggagaccuccucuagcgacaacggcacgugcuauccgggggauuuuauugacuacgaagaacugcgggagcagcuuuccagcgucucuuccuucgaacgcuuugagaucuuccccaagaccagcucuuggccuaaucacgauuccaacaagggagugacagccgcuuguccccaugccggcgcgaaaucuuuuuauaagaaucugaucuggcucguuaaaaagggcaacagcuacccuaaacuguccaagagcuauauuaaugacaaggggaaagaagugcuuguccuguggggaauccaccaccccuccaccucugccgaucaacagagccucuaccagaacgcugacgccuacguguucgugggcuccagcagauauucuaagaaauuuaagccugagauugcuauccggccgaaaguccgcgaucaggaggggagaaugaauuacuauuggacacugguugaacccggagacaagauuaccuucgaggccacgggcaaccugguggugccucgguacgcguuugccauggaacgcaacgcugaguccgggaucauuaucagcgauacacccguccaugacugcaauaccacaugucaaaccccuaaaggagccaucaacaccucucuccccuuccagaauauucacccgaucacaauuggcaagugcccuaaguaugugaaaagcacgaagcugagacuugcuaccggccugcggaacguucccuccauccagucucgcgggcucuuuggagccauugccggcuucaucgaagggggauggacaggcaugguggacgggugguacggauaucaucaccagaaugagcaaggcagcggcuacgcugcggaucugaaauccacccagaacgccaucgacgagauuacaaauaaggucaacagcgugaucgaaaagaugaauacccaguuuacggcuguugggaaggaguucaaccaccuugaaaagagaauugagaaucugaacaaaaagguggaugacggauuccucgauaucuggacauacaaugccgaacugcugguccuccuggagaacgagcggacccuugacuaucaugauucuaaugugaaaaaccuguacgaaaagguccgcucccagcucaaaaacaaugccaaggagauuggcaacggguguuuugaguucuaucacaagugcgacaauaccuguauggagagcgugaaaaacggaacauacgauuauccuaaguacucugaagaggcuaaacugaauagagaggaaaucgacggcguuaaacuugaguccacccggaucuaucaaauucuggccaucuacagcacaguggcguccucucucguccuggugguuagccugggggcuauuuccuuuuggaugugcucuaacggcagccuccagugccgcaucuguauuuga

SEQ ID NO: 186594 - RNA, 1701 nt, Artificial Sequence; identical to SEQ ID NO: 185680
  derived and/or modified sequence opt5 from hemagglutinin__InfluenzaA__ACY77954

SEQ ID NO: 186595 - RNA, 1701 nt, Artificial Sequence; identical to SEQ ID NO: 185680
  derived and/or modified sequence opt5 from hemagglutinin__InfluenzaA__ACY77964

SEQ ID NO: 186596 - RNA, 1701 nt, Artificial Sequence; identical to SEQ ID NO: 185680
  derived and/or modified sequence opt5 from hemagglutinin__InfluenzaA__ACY77974

SEQ ID NO: 186597 - RNA, 1701 nt, Artificial Sequence; identical to SEQ ID NO: 185680
  derived and/or modified sequence opt5 from hemagglutinin__InfluenzaA__ACY77984

SEQ ID NO: 186598 - RNA, 1701 nt, Artificial Sequence; identical to SEQ ID NO: 185680
  derived and/or modified sequence opt5 from hemagglutinin__InfluenzaA__ACY77994

SEQ ID NO: 186599 - RNA, 1701 nt, Artificial Sequence
  derived and/or modified sequence opt5 from hemagglutinin__InfluenzaA__ACY79633
augaaggagauccuggugguccuccuguacaccuucgccacagcuaacgccgacacgcuuugcauuggcuaucacgcgaauaacagcaccgauacaguugacaccgugcuggagaaaaaugugacagucacccauuccgugaaccuccuggaagauaagcacaaugggaaacuuuguaagcugagaggaguugcuccccuccaucugggcaaaugcaacaucgccggguggauucugggaaauccugaaugugagucucucagcacagccuccucuuggagcuacaucguggaaaccuccucuagcgacaacggcacgugcuauccgggggauuuuauugacuacgaggagcugcgggaacagcuuuccagcgucucuuccuucgagcgcuuugaaaucuuccccaagaccagcucuuggccuaaucacgauuccaacaagggagugacagcugccuguccccaugcuggcgccaagagcuuuuauaagaaucugaucuggcucguuaaaaagggcaacucuuacccuaaacuguccaagagcuauauuaaugacaaggggaaagaggugcuuguccuguggggaauccaccaccccuccaccucugcggaucaacagagccucuaccagaacgccgacgcuuacguguucgugggcacauccagauauagcaagaaauuuaagccugagauugccauccggccgaaaguccgcgaucaggaagggagaaugaauuacuauuggacccugguugagcccggagacaagauuacguucgaagcuacaggcaaccugguggugccucgguacgccuuugcgauggagcgcaacgccagaucugggaucauuaucuccgauacccccguccaugacugcaauacaaccugucaaaccccuaaaggagcuaucaacacaagccuccccuuccagaauauucacccgaucacgauuggcaagugcccuaaguaugugaaaucuaccaagcugcggcuugccacaggccugcgcaacguucccagcauccaguccagagggcucuuuggagcuauugccggcuucaucgaagggggauggaccggcaugguggacgggugguacggauaucaucaccagaaugagcaaggcucuggcuacgccgcugaucugaaaagcacacagaacgcgaucgacgagauuaccaauaaggucaacuccgugaucgaaaagaugaauacgcaguuuacagccguugggaaagaguucaaccaccuugaaaagcggauugagaaucugaacaaaaagguggaugacggauuccucgauaucuggaccuacaaugcugaacugcugguccuccuggagaacgagcgcacccuugacuaucaugauagcaaugugaaaaaccuguacgaaaaggucagaucucagcucaaaaacaaugccaaggagauuggcaacggguguuuugaguucuaucacaagugcgacaauacauguauggaauccgugaaaaacggaaccuacgauuauccuaaguacagcgaagaggccaaacugaaucgggaggaaaucgacggcguuaaacuugagucuacacgcaucuaucaaauucuggcuaucuacuccacgguggccagcucccucguccuggugguuucucugggggcgauuagcuuuuggaugugcuccaacggcucucuccagugcagaaucuguauuuga

SEQ ID NO: 186600 - RNA, 1701 nt, Artificial Sequence; identical to SEQ ID NO: 186491
  derived and/or modified sequence opt5 from hemagglutinin__InfluenzaA__ACZ01953
